United States Patent
Brannetti et al.

(10) Patent No.: US 10,525,083 B2
(45) Date of Patent: Jan. 7, 2020

(54) NUCLEIC ACID MOLECULES ENCODING CHIMERIC ANTIGEN RECEPTORS COMPRISING A CD20 BINDING DOMAIN

(71) Applicants: Novartis AG, Basel (CH); The Trustees of the University of Pennsylvania, Philadelphia, PA (US)

(72) Inventors: Barbara Brannetti, Cambridge, MA (US); Jennifer Brogdon, Sudbury, MA (US); Boris Engels, Arlington, MA (US); Brian Granda, Salisbury, MA (US); Lu Huang, West Roxbury, MA (US); Ming Lei, Acton, MA (US); Na Li, Cambridge, MA (US); Jimin Zhang, Chestnut Hill, MA (US); Carla Guimaraes, Boston, MA (US)

(73) Assignees: Novartis AG, Basel (CH); The Trustees of the University of Pennsylvania, Philadelphia, PA (US)

( * ) Notice: Subject to any disclaimer, the term of this patent is extended or adjusted under 35 U.S.C. 154(b) by 0 days.

(21) Appl. No.: 15/727,402

(22) Filed: Oct. 6, 2017

(65) Prior Publication Data
US 2018/0125892 A1    May 10, 2018

Related U.S. Application Data

(60) Provisional application No. 62/405,520, filed on Oct. 7, 2016.

(51) Int. Cl.
| | |
|---|---|
| A61K 35/17 | (2015.01) |
| A61P 35/00 | (2006.01) |
| A61K 38/17 | (2006.01) |
| C12N 15/85 | (2006.01) |
| C07K 16/28 | (2006.01) |
| A61K 39/00 | (2006.01) |

(52) U.S. Cl.
CPC .......... *A61K 35/17* (2013.01); *A61K 38/1774* (2013.01); *A61P 35/00* (2018.01); *C07K 16/2803* (2013.01); *C07K 16/2887* (2013.01); *C07K 16/2896* (2013.01); *C12N 15/85* (2013.01); *A61K 2039/505* (2013.01); *C07K 2317/24* (2013.01); *C07K 2317/31* (2013.01); *C07K 2317/622* (2013.01); *C07K 2319/03* (2013.01); *C07K 2319/33* (2013.01)

(58) Field of Classification Search
CPC ................ A61K 35/17; A61K 38/1774; A61K 2039/505; C07K 16/2803; C07K 16/2887; C07K 16/2896; C07K 2319/03; C07K 2319/33; C07K 2317/24; C07K 2317/31; C07K 2317/622; A61P 35/00; C12N 15/85
See application file for complete search history.

(56) References Cited

U.S. PATENT DOCUMENTS

| | | |
|---|---|---|
| 5,359,046 A | 10/1994 | Capon et al. |
| 5,686,281 A | 11/1997 | Roberts |
| 5,712,149 A | 1/1998 | Roberts |
| 5,786,464 A | 7/1998 | Seed |
| 5,874,240 A | 2/1999 | Ni et al. |
| 5,906,936 A | 5/1999 | Eshhar et al. |
| 6,103,521 A | 8/2000 | Capon et al. |
| 6,111,090 A | 8/2000 | Gorman et al. |
| 6,114,148 A | 9/2000 | Seed et al. |
| 6,319,494 B1 | 11/2001 | Capon et al. |
| 6,355,779 B1 | 3/2002 | Goodwin et al. |
| 6,410,319 B1 | 6/2002 | Raubitschek et al. |
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,132,255 B2 | 11/2006 | Blumberg |
| 7,265,209 B2 | 9/2007 | Jensen |
| 7,319,143 B2 | 1/2008 | Gross et al. |
| 7,320,787 B2 | 1/2008 | Seed et al. |
| 7,402,431 B2 | 7/2008 | Har-Noy |
| 7,446,190 B2 | 11/2008 | Sadelain et al. |
| 7,446,191 B2 | 11/2008 | Jensen |
| 7,514,537 B2 | 4/2009 | Jensen |
| 7,638,325 B2 | 12/2009 | June et al. |
| 7,638,326 B2 | 12/2009 | June et al. |
| 7,741,465 B1 | 6/2010 | Eshhar et al. |
| 7,745,140 B2 | 6/2010 | June et al. |

(Continued)

FOREIGN PATENT DOCUMENTS

| | | |
|---|---|---|
| EP | 215576 A1 | 3/1987 |
| EP | 0574512 A1 | 12/1993 |

(Continued)

OTHER PUBLICATIONS

Paul, WE. Fundamental Immunology, 3rd ed. Raven Press, NY, Chap. 9, pp. 292-295, 1993.*

(Continued)

*Primary Examiner* — Robert S Landsman
(74) *Attorney, Agent, or Firm* — Lando & Anastasi, LLP

(57) ABSTRACT

The invention provides compositions and methods for treating diseases associated with expression of CD20 or CD22. The invention also relates to chimeric antigen receptor (CAR) specific to CD20 or CD22, vectors encoding the same, and recombinant T or natural killer (NK) cells comprising the CD20 CAR or CD22 CAR. The invention also includes methods of administering a genetically modified T cell or NK cell expressing a CAR that comprises a CD20 or CD22 binding domain.

33 Claims, 39 Drawing Sheets
Specification includes a Sequence Listing.

(56) References Cited

U.S. PATENT DOCUMENTS

| | | |
|---|---|---|
| 7,754,482 B2 | 7/2010 | Riley et al. |
| 7,994,298 B2 | 8/2011 | Zhang et al. |
| 8,008,449 B2 | 8/2011 | Korman et al. |
| 8,124,084 B2 | 2/2012 | Lefrancois et al. |
| 8,211,422 B2 | 7/2012 | Eshhar et al. |
| 8,252,914 B2 | 8/2012 | Zhang et al. |
| 8,383,778 B2 | 2/2013 | Hsieh et al. |
| 8,389,282 B2 | 3/2013 | Sadelain et al. |
| 8,399,645 B2 | 3/2013 | Campana et al. |
| 8,465,743 B2 | 6/2013 | Rosenberg et al. |
| 8,637,307 B2 | 1/2014 | June et al. |
| 8,722,400 B2 | 5/2014 | Riley et al. |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,394,368 B2 | 7/2016 | Brogdon et al. |
| 9,464,140 B2 | 10/2016 | June et al. |
| 9,481,728 B2 | 11/2016 | June et al. |
| 9,499,629 B2 | 11/2016 | June et al. |
| 9,573,988 B2 | 2/2017 | Brogdon et al. |
| 9,745,368 B2 | 8/2017 | Milone et al. |
| 9,777,061 B2 | 10/2017 | Ebersbach et al. |
| 9,815,901 B2 | 11/2017 | Brogdon et al. |
| 2003/0060444 A1 | 3/2003 | Finney et al. |
| 2003/0077249 A1 | 4/2003 | Bebbington et al. |
| 2003/0148982 A1 | 8/2003 | Brenner et al. |
| 2003/0224520 A1 | 12/2003 | June |
| 2004/0038886 A1 | 2/2004 | Finney et al. |
| 2004/0043401 A1 | 3/2004 | Sadelain et al. |
| 2005/0113564 A1 | 5/2005 | Campana et al. |
| 2005/0129671 A1 | 6/2005 | Cooper et al. |
| 2007/0036773 A1 | 2/2007 | Cooper et al. |
| 2008/0131415 A1 | 6/2008 | Riddell et al. |
| 2009/0082299 A1 | 3/2009 | Felber et al. |
| 2009/0257994 A1 | 10/2009 | Jensen |
| 2010/0233200 A1 | 9/2010 | Medin |
| 2010/0247521 A1 | 9/2010 | Jones et al. |
| 2011/0052554 A1 | 3/2011 | Zakrzewski et al. |
| 2011/0081311 A1 | 4/2011 | Pavlakis et al. |
| 2012/0141413 A1 | 6/2012 | Pavlakis et al. |
| 2012/0148552 A1 | 6/2012 | Jensen |
| 2012/0177598 A1 | 7/2012 | Lefrancois et al. |
| 2012/0321667 A1 | 12/2012 | Sentman |
| 2013/0071409 A1 | 3/2013 | Riley et al. |
| 2013/0071414 A1 | 3/2013 | Dotti et al. |
| 2013/0149337 A1 | 6/2013 | Cooper et al. |
| 2013/0155909 A1 | 6/2013 | Jackson et al. |
| 2013/0287748 A1 | 10/2013 | June et al. |
| 2013/0288368 A1 | 10/2013 | June et al. |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1 | 9/2014 | Brogdon et al. |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0370017 A1 | 12/2014 | June et al. |
| 2014/0370045 A1 | 12/2014 | June et al. |
| 2015/0017141 A1 | 1/2015 | June et al. |
| 2015/0050729 A1 | 2/2015 | June et al. |
| 2015/0093822 A1 | 4/2015 | June et al. |
| 2015/0099299 A1 | 4/2015 | June et al. |
| 2015/0118202 A1 | 4/2015 | June et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0130355 A1 | 5/2016 | June et al. |
| 2016/0159907 A1 | 6/2016 | June et al. |
| 2016/0185861 A1 | 6/2016 | Bedoya et al. |
| 2016/0194404 A1 | 7/2016 | June et al. |
| 2016/0208012 A1 | 7/2016 | June et al. |
| 2016/0311907 A1 | 10/2016 | Brogdon et al. |
| 2016/0311917 A1 | 10/2016 | Beatty et al. |
| 2016/0340406 A1 | 11/2016 | Zhao et al. |
| 2016/0362472 A1 | 12/2016 | Bitter et al. |
| 2017/0008963 A1 | 1/2017 | Brogdon et al. |
| 2017/0081411 A1 | 3/2017 | Engels et al. |
| 2017/0137783 A1 | 5/2017 | Bedoya et al. |
| 2017/0183415 A1 | 6/2017 | Brogdon et al. |
| 2017/0209492 A1 | 7/2017 | June et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhonenko et al. |
| 2017/0260268 A1 | 9/2017 | Beatty et al. |
| 2017/0274014 A1 | 9/2017 | Brogdon et al. |
| 2017/0306416 A1 | 10/2017 | Bedoya et al. |
| 2017/0335281 A1 | 11/2017 | Loew et al. |
| 2018/0022795 A1 | 1/2018 | Milone et al. |
| 2018/0044423 A1 | 2/2018 | Ebersbach et al. |
| 2018/0044424 A1 | 2/2018 | June et al. |
| 2018/0118834 A1 | 5/2018 | Brogdon et al. |
| 2018/0133296 A1 | 5/2018 | Barrett et al. |
| 2018/0140602 A1 | 5/2018 | Angst et al. |
| 2018/0230193 A1 | 8/2018 | Loew et al. |
| 2018/0252727 A1 | 9/2018 | Garfall et al. |
| 2018/0258149 A1 | 9/2018 | Motz et al. |
| 2018/0298068 A1 | 10/2018 | Albelda |
| 2018/0312595 A1 | 11/2018 | Brogdon et al. |
| 2019/0000880 A1 | 1/2019 | Motz et al. |
| 2019/0000944 A1 | 1/2019 | Brogdon et al. |
| 2019/0135940 A1 | 5/2019 | Brogdon et al. |
| 2019/0151365 A1 | 5/2019 | Anak et al. |
| 2019/0153061 A1 | 5/2019 | Brogdon et al. |
| 2019/0161542 A1 | 5/2019 | Gill et al. |

FOREIGN PATENT DOCUMENTS

| | | |
|---|---|---|
| EP | 0871495 A1 | 10/1998 |
| EP | 1226244 A2 | 7/2002 |
| JP | 2003517301 A | 5/2003 |
| JP | 2004529636 A | 9/2004 |
| WO | 1992015322 A1 | 9/1992 |
| WO | 9507984 A1 | 3/1995 |
| WO | 199530014 A1 | 11/1995 |
| WO | 9623814 A1 | 8/1996 |
| WO | 9624671 A1 | 8/1996 |
| WO | 1997015669 A1 | 5/1997 |
| WO | 9723613 A2 | 7/1997 |
| WO | 9818809 A1 | 5/1998 |
| WO | 9900494 A2 | 1/1999 |
| WO | 9921581 A1 | 5/1999 |
| WO | 9957268 A1 | 11/1999 |
| WO | 0014257 A1 | 3/2000 |
| WO | 200134843 A1 | 5/2001 |
| WO | 2002033101 A1 | 4/2002 |
| WO | 02077029 A2 | 10/2002 |
| WO | 02088334 A1 | 11/2002 |
| WO | 2003057171 A2 | 7/2003 |
| WO | 2004/003019 A2 | 1/2004 |
| WO | 2005019429 A2 | 3/2005 |
| WO | 2005044996 A2 | 5/2005 |
| WO | 2005/118788 A2 | 12/2005 |
| WO | 2006060878 A1 | 6/2006 |
| WO | 2008045437 A2 | 4/2008 |
| WO | 2008049928 A1 | 5/2008 |
| WO | 2009091826 A2 | 7/2009 |
| WO | 2010019570 A2 | 2/2010 |

(56) References Cited

FOREIGN PATENT DOCUMENTS

| | | |
|---|---|---|
| WO | 2010025177 A1 | 3/2010 |
| WO | 2010085660 A2 | 7/2010 |
| WO | 2010095031 A2 | 8/2010 |
| WO | 2011059836 A2 | 5/2011 |
| WO | 2011097477 A1 | 8/2011 |
| WO | 2012058460 A2 | 5/2012 |
| WO | 2012079000 A1 | 6/2012 |
| WO | 2012082841 A2 | 6/2012 |
| WO | 2012/099973 A2 | 7/2012 |
| WO | 2012127464 A2 | 9/2012 |
| WO | 2012129514 A1 | 9/2012 |
| WO | 2012135854 A2 | 10/2012 |
| WO | 2012138858 A1 | 10/2012 |
| WO | 2013019615 A2 | 2/2013 |
| WO | 2013033626 A2 | 3/2013 |
| WO | 2013040371 A2 | 3/2013 |
| WO | 2013040557 A2 | 3/2013 |
| WO | 2013059593 A1 | 4/2013 |
| WO | 2013/126712 A1 | 8/2013 |
| WO | 2013123061 A1 | 8/2013 |
| WO | 2013126729 A1 | 8/2013 |
| WO | 2013126733 A1 | 8/2013 |
| WO | 2014/011984 A1 | 1/2014 |
| WO | 2014/011987 A1 | 1/2014 |
| WO | 2014/011993 A2 | 1/2014 |
| WO | 2014/012001 A2 | 1/2014 |
| WO | 2014011988 A2 | 1/2014 |
| WO | 2014011996 A1 | 1/2014 |
| WO | 2014031687 A1 | 2/2014 |
| WO | 2014039513 A2 | 3/2014 |
| WO | 2014/055442 A2 | 4/2014 |
| WO | 2014055657 A1 | 4/2014 |
| WO | 2014130635 A1 | 8/2014 |
| WO | 2014/145252 A2 | 9/2014 |
| WO | 2014153270 A1 | 9/2014 |
| WO | 2015075468 A1 | 5/2015 |
| WO | 2015079417 A1 | 6/2015 |
| WO | 2015090229 A1 | 6/2015 |
| WO | 2015090230 A1 | 6/2015 |
| WO | 2015112626 A1 | 7/2015 |
| WO | 2015/142661 A1 | 9/2015 |
| WO | 2015142675 A2 | 9/2015 |
| WO | 2015157252 A1 | 10/2015 |
| WO | 2016014501 A1 | 1/2016 |
| WO | 2016014530 A1 | 1/2016 |
| WO | 2016014535 A1 | 1/2016 |
| WO | 2016014553 A1 | 1/2016 |
| WO | 2016014565 A2 | 1/2016 |
| WO | 2016014576 A1 | 1/2016 |
| WO | 2016019300 A1 | 2/2016 |
| WO | 2016025880 A1 | 2/2016 |
| WO | 2016028896 A1 | 2/2016 |
| WO | 2016044605 A1 | 3/2016 |
| WO | 2016102965 A1 | 6/2016 |
| WO | 2016/164580 A1 | 10/2016 |
| WO | 2016164731 A2 | 10/2016 |
| WO | 2018067992 A1 | 4/2018 |

OTHER PUBLICATIONS

Rudikoff S. et al. Proc. Natl. Acad. Sci. USA, 79:1979-1983, 1982.*
Colman, PM. Research in Immunology, Elsevier, NY, 145(1):33-36, 1994.*
FDA: Highlights of Prescribing Information for RITUXAN (2010).
Finn et al., "Current and Future Treatment Strategies for Patients with Advanced Hepatocellular Carcinoma: Role of mTOR Inhibition." Liver Cancer (2012) vol. 1 No. 3-4 pp. 247-256.
Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Forero-Torres et al., "Results of a phase 1 study of AME-133v (LY2469298), an Fc-engineered humanized monoclonal anti-CD20 antibody, in Fc?RIIIa-genotyped patients with previously treated follicular lymphoma." Clinical Cancer Research (2012) vol. 18 No. 5 pp. 1395-1403.
Fraietta et al., "Ibrutinib enhances chimeric antigen receptor T-cell engraftment and efficacy in leukemia" Blood (2016) vol. 127 No. 9 pp. 1117-1127.
Fraietta et al., "P.D.14.19—Longitudinal Effects of Ibrutinib Therapy on T Lymphocytes: Implications for Combination Adoptive Cell Strategies to Treat Chronic Lymphocytic Leukemia (CLL)" The 4th European Congress of Immunology (2015) Presentation Abstract.
Freeman et al "Engagement of the PD-1 Immunoinhibitory Receptor by a Novel B7 Family Member Leads to Negative Regulation of Lymphocyte Activation", Journal of Exp Med (2000) vol. 192 No. 7 pp. 1027-1034.
Frey, N. "Genetically Engineered Lymphocyte Therapy in Treating Patients With B-Cell Leukemia or Lymphoma That is Resistant or Refractory to Chemotherapy" (2015) Clinical Trial NCT01029366.
Friedmann-Morvinski et al., "Redirected primary T cells harboring a chimeric receptor require costimulation for their antigen-specific activation," Blood 105: 3087-3093 (2005).
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and constimulatory activity enhances signal transduction through single-chain chimeric receptors in T lymphocytes," Blood 98(8): 2364-2371 (2001).
GenBank Acc. No. AAA62478.2 (41bb).
GenBank Acc. No. BAG36664.1 (zeta).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.
Goldenberg et al., "Veltuzuman (humanized anti-CD20 monoclonal antibody): characterization, current clinical results, and future prospects" Leukemia & Lymphoma (2010) vol. 51 No. 5 pp. 747-755.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.
Griffin, "Development and applications of surface-linked single chain antibodies against T-cell antigens" Journal of Immunological Methods (2001) vol. 248 pp. 77-90.
Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
Haso et al. "Anti-CD22-chimeric antigen receptors targeting B cell precursor acute lymphoblastic leukemia" Blood (2012) ; doi:10.1182/blood-2012-06-438002.
Hekele et al., "Growth Retardation of Tumors by Adoptive Transfer of Cytotoxic T Lymphocytes Reprogrammed by CD44V6-Specific SCFV:~-Chimera" Int J. Cancer (1996) vol. 68 pp. 232-238.
Henderson et al., "Comparison of the effects of FK-506, cyclosporin A and rapamycin on IL-2 production." Immunology (1991) No. 73 vol. 3 pp. 316-321.

(56) References Cited

OTHER PUBLICATIONS

Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD19 antigen for autologous adoptive cell therapy" J Immunother (2009) vol. 32 No. 2 pp. 169-180.
Hombach et al. "OX40 costimulation by a chimeric antigen receptor abrogates CD28 and IL-2 induced IL-10 secretion by redirected CD4+ T cells" OncoImmunology (2012) vol. 1, No. 4, pp. 458-466.
Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Honigberg et al., "The Bruton tyrosine kinase inhibitor PCI-32765 blocks B-cell activation and is efficacious in models of autoimmune disease and B-cell malignancy." Proc Natl Acad Sci (2010) vol. 107 No. 29 pp. 13075-13080.
Hutchinson et al. "Breaking good: the inexorable rise of BTK inhibitors in the treatment of chronic lymphocytic leukaemia" British Journal of Haematology (2014) vol. 166, pp. 12-22.
Huye E L et al: 'Combining mTor Inhibitors With Rapamycin-resistant T Cells: A Two-pronged Approach to Tumor Elimination',Molecular Therapy,vol. 19, No. 12, Aug. 30, 2011 (Aug. 30, 2011), pp. 2239-2248, XP055191016, GB, ISSN: 1525-0016, DOI: 10.1038/mt.2011.179 the whole document.
Imai et al., "Chimeric receptors with 4-1BB signaling capacity provoke potent cytotoxicity against acute lymphoblastic leukemia," Leukemia 18: 676-684 (2004).
Imai et al., "Genetic modification of primary natural killer cells overcomes inhibitory signals and induces specific killing of leukemic cells" Blood (2005) vol. 106 No. 1 pp. 376-383.
International Preliminary Report on Patentability for International Application No. PCT/US2014/029943 dated Sep. 22, 2015.
International Search Report and Written Opinion for International Application No. PCT/US2014/029943 dated Jul. 17, 2014.
International Search Report and Written Opinion for International application No. PCT/US2015/024671, dated Jul. 31, 2015.
International Search Report and Written Opinion for International Application No. PCT/US2016/026437 dated Jun. 29, 2016.
International Search Report and Written Opinion for International Application No. PCT/US2016/026655 dated May 10, 2016.
International Search Report from PCT/US2011/064191 dated Jan. 5, 2012.
Intlekofer et al. "At the Bench: Preclinical rationale for CTLA-4 and PD-1 blockade as cancer immunotherapy" J Leukoc Biol (2013) vol. 94, No. 1, pp. 25-39.
Irving et al., "The cytoplasmic domain of the T cell receptor zeta chain is sufficient to couple to receptor-associated signal transduction pathways," Cell 64: 891-901 (1991).
Jena, Bipulendu et al. "Redirecting T-cell specificity by introducing a tumor-specific chimeric antigen receptor, Blood, May 3, 2010", vol. 116, No. 7, pp. 1035-1044.
Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.
Johnson et al., "Gene therapy with human and mouse T-cell receptors mediates cancer regression and targets normal tissues expressing cognate antigen" Blood (2009) vol. 114 No. 3 pp. 535-545.
Jones et al., "Circulating clonotypic B cells in classic Hodgkin lymphoma." Blood (2009) vol. 113 No. 23 pp. 5920-5926.
Joo et al., "Targeted cancer therapy—are the days of systemic chemotherapy numbered?" Maturitas (2013) vol. 76 No. 4 pp. 308-314.
June et al., "Engineering lymphocyte subsets: tools, trials and tribulations" Nat Rev Immunol (2009) vol. 9 No. 10 pp. 104-116.
"EP Vantage—ASH—Novartis, 3-35 Juno, June and Rosenberg steal the T-cell show" EP Vantage (2014) Retrieved from the Internet: http://epvantage.com/universal/view.aspx?type=story&id=546429&isEPVantage=yes; Retrived on Jul. 25, 2016.
"Pilot study for Patients with chemotherapy resistant or refractory CD19 Leukemia and Lymphoma (CART-19)" ClinicalTrials.gov Identifier NCT00891215; Retrieved from the internet on Sep. 2, 2015 Found at http://web.archive.org/web/20090903002304/http://clinicaltrials.gov/ct2/show/study/NCT00891215.
A NCBI Direct Submission NP 000725 dated Nov. 21, 2010.
A NCBI Direct Submission NP 932170.1 dated Nov. 21, 2010.
Advani et al., "Bruton tyrosine kinase inhibitor ibrutinib (PCI-32765) has significant activity in patients with relapsed/refractory B-cell malignancies." Journal of Clinical Oncology (2012) vol. 31 No. 1 pp. 88-94.
Advani et al., "Bruton tyrosine kinase inhibitor ibrutinib (PCI-32765) has significant activity in patients with relapsed/refractory B-cell malignancies." Journal of Clinical Oncology (2013) vol. 31 No. 1 pp. 88-94.
Agata et al. "Expression of the PD-1 antigen on the surface of stimulated mouse T and B lymphocytes", International Immunology (1996) vol. 8 No. 5 pp. 765-772.
AppliChem product sheet for RPMI-1640, 2 pages, downloaded Dec. 28, 2015.
Awan and Byrd, "New Strategies in Chronic Lymphocytic Leukemia: Shifting Treatment Paradigms" Clinical Cancer Research (2014) vol. 20 No. 23 pp. 5869-5874.
Baeksgaard & Sorensen, "Acute tumor lysis syndrome in solid tumors—a case report and review of the literature" Cancer Chemotherapy Pharmacology (2003) vol. 51 pp. 187-192.
Batzer et al. "Enhanced evolutionary PCR using oligonucleotides with inosine at the 3'-terminus" (1991) vol. 19, No. 18, pp. 5081.
Bierer et al., "Cyclosporin A and FK506: molecular mechanisms of immunosuppression and probes for transplantation biology" Current Opinion in Immunology (1992) vol. 5 pp. 763-773.
Blank et al. "Interaction of PD-L1 on tumor cells with PD-1 on tumor-specific T cells as a mechanism of immune evasion: implications for tumor immunotherapy." Cancer Immunol Immunother (2005) vol. 54 No. 4 pp. 307-314.
Bondanza et al. "Suicide gene therapy of graft-versus-host disease induced by central memory human T lymphocytes" Blood (2006) vol. 107 No. 5 pp. 1828-1836.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Novel cellular therapies for leukemia: CAR-modified T cells targeted to the CD19 antigen" Hematology (2012) pp. 143-151.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor-Chain alone Are Insufficient to Prime Resting T Lymphocytes" J. Exp. Med. (1995) vol. 181 pp. 1653-1659.
Brown J R et al: "Novel Treatments for Chronic Lymphocytic Leukemia and Moving Forward",American Society of Clinical Oncology Educational Book,vol. 34, 2014, pp. e317-e325,XP05520 1368,ISSN: 1548-8748, DOI:10.14694/EdBook_AM.2014..34. e317 the whole document.

(56) References Cited

OTHER PUBLICATIONS

Byrd et al., "Targeting BTK with ibrutinib in relapsed chronic lymphocytic leukemia." New England Journal of Medicine (2013) vol. 369 No. 1 pp. 32-42.
Call & Wucherpfennig, "The T Cell Receptor: Critical Role of the Membrane Environment in Receptor Assembly and Function" Annu. Rev. Immunol. (2005) vol. 23 pp. 101-125.
Campana et al., 2003 Blood 102(11); abstract #223.
Carpenito et al. "Control of large, established tumor xenografts with genetically retargeted human T cells containing CD28 and CD137 domains", Proc Natl Mad Sci USA (2009) vol. 106 pp. 3360-3365.
Carter et al. "PD-1:PD-L inhibitory pathway affects both CD4+ and CD8+ T cells and is overcome by IL-2" Eur. J. Immunol. (2002) vol. 32 pp. 634-643.
Casulo et al., "A phase I study of PRO131921, a novel anti-CD20 monoclonal antibody in patients with relapsed/refractory CD20+ indolent NHL: correlation between clinical responses and AUC pharmacokinetics." Clinical Immunology (2014) vol. 154 No. 1 pp. 37-46.
Cheson et al., "Report of an International Workshop to Standardize Response Criteria for Non-Hodgkin's Lynphomas" Journal of Clinical Oncology (1999) vol. 17 pp. 1244-1253.
Chothia et al. "Canonical structures for the hypervariable regions of immunoglobulins" Journal of Molecular Biology (1987) vol. 196, No. 4, pp. 901-917.
Colman et al. "Effects of amino acid sequence changes on antibody-antigen interactions" Research in Immunology (1994) vol. 145, pp. 33-36.
Cooper et al. "Test-driving CARs" Blood (2008) vol. 112, No. 5, pp. 2172-2173.
Cruz et al. "Adverse events following infusion of T cells for adoptive immunotherapy: a 10-year experience" Cytotherapy (2010) vol. 12, No. 6, pp. 743-749.
Davila et al, "T Cells Genetically Targeted to CD19 Eradicate B-All in a Novel Syngeneic Mouse Disease Model" 2010 ASH Abstract No. 171, presented Dec. 6, 2010 (poster abstract).
Davila et al. "B Cell Aplasia in a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.
De Visser et al., "De novo carcinogenesis promoted by chronic inflammation is B lymphocyte dependent." Cancer Cell (2005) vol. 7 No. 5 pp. 411-423.
Di Stasi et al., "Inducing apoptosis as a safety switch for adoptive cell therapy" New England Journal of Medicine (2011) vol. 365 No. 18 pp. 1673-1683.
Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.
Dong et al. "B7-H1 pathway and its role in the evasion of tumor immunity." J Mol Med (2003) vol. 81 No. 5 pp. 281-287.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dubovsky et al., "Ibrutinib is an irreversible molecular inhibitor of ITK driving a Th1-selective pressure in T lymphocytes." Blood (2013) vol. 122 No. 15 pp. 2539-2549.
Dudley et al. "Malignancy Persisting After Allogeneic Hematopoietic Stem Cell Transplantation" Blood (2013) vol. 122, No. 21, pp. 151—Abstract Only.
Dull et al, "A Third-Generation Lentivirus Vector with a Conditional Packaging System" Journal of Virology (1998) vol. 72 No. 11 pp. 8463-8471.
Durie et al. "International uniform response criteria for multiple myeloma" Leukemia (2006) vol. 20, No. 9, pp. 1467-1473.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).
Evans et al., "Evolution to Plasmablastic Lymphoma (PBL) after CAR-T Cell Therapy in a Case of SLL/CLL with Richter's Transformation" Blood (2014) vol. 124 No. 21.
FDA: Highlights of Prescribing Information for ARZERRA (2009).
FDA: Highlights of Prescribing Information for GAZYVA (2013).
June, "Adoptive T cell therapy for cancer in the clinic" Journal of Clinical Investigation (2007) vol. 117 No. 6 pp. 1466-1476.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kalos et al.,"T cells with chimeric antigen receptors have potent antitumor effects and can establish memory in patients with advanced leukemia." Science Translational Medicine (2011) vol. 3 No. 95 95ra73.
Kappos et al., "Ocrelizumab in relapsing-remitting multiple sclerosis: a phase 2, randomised, placebo-controlled, multicentre trial." Lancet (2011) vol. 378 No. 9805 pp. 1779-1787.
Karlsson et al. "Combining CAR T cells and the Bcl-2 family apoptosis inhibitor ABT-737 for treating B-cell malignancy" Cancer Gene Therapy (2013) vol. 20, pp. 386-393.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al. "B-cell Depletion Using an Anti-CD20 Antibody Augments Antitumor Immune Responses and Immunotherapy in Nonhematopoetic Murine Tumor Models" Journal of Immunotherapy (2008) vol. 31 No. 5 pp. 446-457.
Kim et al., "Human 4-1BB regulates CD28 co-stimulation to promote Th1 cell responses" Eur. J. Immunol. (1998) vol. 28 pp. 881-890.
Kochenderfer et al, "A Phase I Clinical Trial of Treatment of B-Cell Malignancies with Autologous Anti-Cd19-CAR-Transduced T Cells" Blood (2010) vol. 116 No. 21 pp. 1179-1180 & 52nd Annual Meeting of the American-Society-of-Hematology (ASH), Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 389-702.
Kochenderfer et al., "Eradication of B-lineage cells and regression of lymphoma in a patient treated with autologous T cells genetically-engineered to recognize CD19," Blood 116: 4099-4102 (2010).
Kochenderfer et al., "Novel Antigen-Specific Expansion of T Cells Transduced with a CD19 Chimeric Antigen Receptor" 2010 ASH Meeting Abstract No. 3262, presented Dec. 6, 2010 (poster abstract).
Kochenderfer, et al. "Adoptive transfer of syngeneic T cells transduced with a chimeric antigen receptor that recognizes murine CD19 can eradicate lymphoma and normal B cells" Blood (2010) vol. 116, No. 9, pp. 3875-3886.
Kofler et al. "CD28 Costimulation Impairs the Efficacy of a Redirected T-cell Antitumor Attack in the Presence of Regulatory T cells Which Can Be Overcome by Preventing Lck Activation" Molecular Therapy (2001) vol. 19, No. 4, 760-767.
Kohn et al. "CARs on Track in the Clinic", Molecular Therapy (2011) vol. 19, No. 3, pp. 432-438.
Konishi et al. "B7-H1 Expression on Non-Small Cell Lung Cancer Cells and Its Relationship with Tumor-Infiltrating Lymphocytes and Their PD-1 Expression" Clinical Cancer Research (2004) vol. 10 pp. 5094-5100.
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Kumar et al. "Molecular Cloning and Expression of the Fabs of Human Autoantibodies in *Escherichia coli*" The Journal of Biological Chemistry (2000) vol. 275, No. 45, pp. 35129-35136.
Kwon et al., "cDNA sequences of two inducible T-cell genes". Proc. Natl. Acad. Sci. U.S.A. 86(6): 1963-1967 (1989).
Lamanna et al., "Pentostatin, Cyclophosphamide, and Rutuximab Is an Active, Well-Tolerated Regimen for Patients With Previously Treated Chronic Lymphocytic Leukemia" Journal of Clinical Oncology (2008) vol. 24 No. 10 pp. 1575-1581.

(56) References Cited

OTHER PUBLICATIONS

Lamers et al. "Immune responses to transgene and retroviral vector in patients treated with ex vivo-engineered T cells" Blood (2011) vol. 117, No. 1, pp. 72-82.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Laport et al., "Adoptive transfer of costimulated T cells induces lymphocytosis in patients with relapsed/refractory non-Hodgkin lymphoma following CD34 +-selected hematopoietic cell transplantation" Blood (2003) vol. 102 No. 6 pp. 2004-2013.
Latchman et al. "PD-L2 is a second ligand for PD-1 and inhibits T cell activation", Nat Immunol (2001) vol. 2 No. 3 pp. 261-268.
Lee et al. "Xenograft models for the preclinical evaluation of new therapies in acute leukemia" Leukemia & Lymphoma (2007) vol. 48, No. 4, pp. 659-668.
Lee et al., "In vivo Inhibition of Human CD19-Targeted Effector T Cells by Natural T Regulatory Cells in a Xenotransplant Murine Model of B Cell Malignancy" Cancer Research (2011) vol. 71 No. 8 pp. 2871-2881.
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector" PNAS (2006) vol. 103 No. 46 pp. 17372-17377.
Lim et al., "Anti-CD20 monoclonal antibodies: historical and future perspectives." Haematologica (2010) vol. 95 No. 1 pp. 135-143.
Liu et al., "Calcineurin is a common target of cyclophilin-cyclosporin A and FKBP-FK506 complexes." Cell (1991) vol. 66 No. 4 pp. 807-815.
Macallan et al., "Measurement and modeling of human T cell kinetics" European Journal of Immunology (2003) vol. 33 pp. 2316-2326.
Maher et al., "Human T lymphocyte cytotoxicity and proliferation directed by a single chimeric TCRzeta/CD28 receptor," Nat. Biotechnol. 20: 70-75 (2002).
Martz et al. "Overcoming ibrutinib resistance" SciBX (2014) vol. 7, No. 33, pp. 1-3.
Marzec et al., "Mantle cell lymphoma cells express predominantly cyclin D1a isoform and are highly sensitive to selective inhibition of CDK4 kinase activity." Blood (2006) vol. 108 No. 5 pp. 1744-1750.
Mato et al., "Favorable Outcomes in CLL Pts with Alternate Kinase Inhibitors Following Ibrutinib or Idelalisib Discontinuation: Results from a Large Multi-Center Study" Blood (2015) vol. 126 No. 23.
Mato et al., "Ibrutinib-induced pneumonitis in patients with chronic lymphocyticleukemia" Blood (2016) vol. 127 No. 8 pp. 1064-1067.
Maude et al., "Chimeric Antigen Receptor T Cells for Sustained Remissions in Leukemia" The New England Journal of Medicine (2014) vol. 371 No. 16 pp. 1507-1517.
Maude, "217 Efficacy of Humanized CD19-Targeted Chimeric Antigen Receptor (CAR)-Modified T Cells in Children and Young Adults with Relapsed/Refractory Acute Lymphoblastic Leukemia" 58th Annual Meeting & Exposition—Dec. 3, 2016; Abstract.
McGuinness et al., "Anti-tumor activity of human T cells expressing the CC49-zeta chimeric immune receptor," Hum. Gene Ther. 10: 165-173 (1999).
Mihara et al. "Synergistic and 1,2,5-36 persistent effect of T-cell imnunotherapy with anti-CD19 or anti-CD38 chimeric receptor in conjunction with rituximab on B-cell non-Hodgkin lymphoma" British Journal of Haematology (2010) vol. 151, No. 1, pp. 37-46.
Milone et al, "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.

Milone et al, Supplementary Materials and Methods, Mol. Ther (2009) vol. 17, 7 pages.
Moeini et al., "Emerging signaling pathways in hepatocellular carcinoma." Liver Cancer (2012) vol. 1 No. 2 pp. 83-93.
Molina, "A Decade of Rituximab: Improving Survival Outcomes in Non-Hodgkin's Lymphoma" Annu. Rev. Med. (2008) vol. 59 pp. 237-250.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
NCBI accession HM_852952 accessed Sep. 29, 2015 from http://www.ncbi.nlm.nih.gov/nuccore/hm852952.
International Search Report and Written Opinion for International Application No. PCT/US2017/055627 dated Mar. 26, 2018.
Invitation to Pay additional Fees from International Application No. PCT/US2017/055627 dated Feb. 5, 2018.
Maude et al. "CD19-targeted chimeric antigen receptor T-cell therapy for acute lymphoblastic leukemia" Blood (2015) vol. 125, No. 26, pp. 4017-4023.
Zhang et al. "Treatment of CD20-directed Chimeric Antigen Receptor-modified T cells in patients with relapsed or refractory B-cell non-Hodgkin lymphoma: an early phase IIa trial report" Signal Transduction and Targeted Therapy (2016) vol. 1, No. 16002, pp. 1-9.
Vajdos et al. "Comprehensive Functional Maps of the Antigen-binding Site of an Anti-ErbB2 Antibody Obtained with Shotgun Scanning Mutagenesis" Journal of Molecular Biology (2002) vol. 320, pp. 415-428.
Vinay & Kwon, "Role of 4-1BB in immune responses" Immunology (1998) vol. 10 pp. 481-489.
Wang et al. "VISTA, a novel mouse Ig superfamily ligand that negatively regulates T cell responses" The Journal of Experimental Medicine (2011) vol. 208, No. 3, 577-592.
Wang et al. "Targeting BTK with ibrutinib in relapsed or refractory mantle-cell lymphoma." New England Journal of Medicine (2013) vol. 369 No. 6 pp. 507-516.
Wang et al., "Utilization of Next Generation Sequencing Identifies Potentially Actionable Mutations with Prognostic Significance in Chronic Lymphocytic Leukemia" Blood (2015) vol. 126 No. 23.
Ward et al. "Binding activities of a repertoire of single immunoglobulin variable domains secreted from *Escherichia coli*" Nature (1989) vol. 341, pp. 544-546.
Willemsen et al., "Genetic Engineering of T Cell Specificity for Immunotherapy of Cancer" Human Immunology (2003) vol. 64 pp. 56-68.
Woyach et al., "Resistance mechanisms for the Bruton's tyrosine kinase inhibitor ibrutinib." New England Journal of Medicine (2014) vol. 370 No. 24 pp. 2286-2294.
Xu et al. "γc Cytokines IL7 and IL15 Expanded Chimeric Antigen Receptor-Redirected T Cells (CAR-T) with Superior Antitumor Activity In Vivo" Molecular Therapy (2013) vol. 21, pp. S20-S21.
Xu V et al: "Closely related T-memory stem cells correlate with in vivo expansion of CAR.CD19-T cells and are preserved by IL-7 and IL-15", Blood, vol. 123, No. 24, Apr. 29, 2014 (Apr. 29, 2014), pp. 3750-3759, XP055201372, ISSN: 0006-4971, DOI:10.1182/blood-2014-01-552174.
Younes et al., "Phase 2 study of rituximab plus ABVD in patients with newly diagnosed classical Hodgkin lymphoma." Blood (2012) vol. 119 No. 18 pp. 4123-4128.
Zah et al. "T cells expressing CD19/CD20 bi-specific chimeric antigen receptors prevent antigen escape by malignant B cells" Cancer Immunology Research (2016) vol. 4, No. 6, pp. 498-508.

(56) References Cited

OTHER PUBLICATIONS

Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Ebersbach et al. "Antigen Presentation for the Generation of Binding Molecules Antibody Methods and Protocols" Methods in Molecular Biology (2012) vol. 901, pp. 1-10.
GenBank Accession No. AAA62478.2 (41bb), retrieved from ncbi.nlm.nih.gov/protein/AAA62478.2 on Jan. 3, 2017, 2 pages.
GenBank Accession No. BAG36664.1 (zeta), retrieved from ncbi.nlm.nih.gov/protein/BAG36664.1 on Jan. 3, 2017, 2 pages.
Hudecek et al. "Receptor Affinity and Extracellular Domain Modifications Affect Tumor Recognition by ROR1-Specific Chimeric Antigen Receptor T Cells" Clinical Cancer Research (2013) vol. 19, No. 12, pp. 3153-3164.
Irving et al. "Functional Characterization of a Signal Transducing Motif Present in the T Cell Antigen Receptor Chain" J. Exp. Med. (1993) vol. 177, pp. 1093-1103.
Jang et al. "Human 4-1BB (CD137) Signals Are Mediated by TRAF2 and Activate Nuclear Factor-kB" Biochemical and Biophysical Research Communications (1998) vol. 242, pp. 613-620.
Jensen et al. "Human T Lymphocyte Genetic Modification with Naked DNA" Molecular Therapy (2000) vol. 1, No. 1, pp. 49-55.
Johnson et al. "Rational development and characterization of humanized anti-EGFR variant III chimeric antigen receptor T cells for glioblastoma" Sci Transl Med (2015) vol. 7, No. 275, 275ra22, pp. 1-30.
Jonnalagadda et al. "Chimeric Antigen Receptors With Mutated IgG4 Fc Spacer Avoid Fc Receptor Binding and Improve T Cell Persistence and Antitumor Efficacy" Molecular Therapy (2015) vol. 23, No. 4, pp. 757-768.
NCBI Accession No. NM_001178098.1, retrieved from ncbi.nlm.nih.gov/nuccore/296010920 on Sep. 6, 2016, 6 pages.
Sadelain et al. "The Basic Principals of Chimeric Antigen Receptor Design" Cancer Discovery (2013) DOI:10.1158/2159-8290.CD-12-0548; pp. 1-11.
UniProt/Swiss-Prot Accession No. P15391 (CD19_HUMAN), retrieved from uniprot.org/uniprot/P15391 on Sep. 6, 2016, 16 pages.
Nicholson et al., "Construction and Characterisation of a Function CD19 Specific Single Chain Fv Fragment for Immunotherapy of B Lineage Leukaemia and Lymphoma," Molecular Immunology 34(I6-I7): 1157-1165 (1997).
Ochoa et al, "Immune Defects in T Cells from Cancer Patients, Parallels in Infectious Diseases" Cancer Immunotherapy at the Crossroads: how tumors evade immunity and what can be done (current clinical oncology), edited by James H. Finke, Ronald M. Bukowski, 2004 edition.
Ohtsuka et al. "An Alternative Approach to Deoxyoligonucleotides as Hybridization Probes by Insertion of Deoxyinosine at Ambiguous Codon Positions" The Journal of Biological Chemistry (1985) vol. 260, No. 5, pp. 2605-2601.
Pardoll, "The blockade of immune checkpoints in cancer immunotherapy" Cancer (2012) vol. 12 pp. 252-264.
Parikh et al., "How we treat Richter syndrome." Blood (2014) vol. 123 No. 11 pp. 1647-1657.
Park and Brentjens "Adoptive Immunotherapy for B-cell Malignancies with Autologous Chimeric Antigen Receptor Modified Tumor Targeted T Cells" Discovery Medicine (2010) vol. 9 No. 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No. 4 pp. 825-833.
Patel et al., "Impact of chimeric immune receptor extracellular protein domains on T cell function" Gene Therapy (1999) vol. 6 pp. 412-419.

Ponader et al., "The Bruton tyrosine kinase inhibitor PCI-32765 thwarts chronic lymphocytic leukemia cell survival and tissue homing in vitro and in vivo" Blood (2012) vol. 119 No. 5 pp. 1182-1189.
Porter et al. "Chimeric Antigen Receptor-Modified T Cells in Chronic Lymphoid Leukemia", The New England Journal of Medicine (2011) vol. 365 No. 8 pp. 725-733.
Porter et al., "A phase 1 trial of donor lumphocyte infusions expanded and activated ex vivo via CD3/CD28 costimulation" Blood (2006) vol. 107 No. 4 pp. 1325-1331.
Porter et al., "Chimeric antigen receptor T cells persist and induce sustained remissions in relapsed refractory chronic lymphocytic leukemia" Science Translational Medicine (2015) vol. 7 No. 303 303ra139.
Porter et al., "Chimeric Antigen Receptor Therapy for B-cell Malignancies" Journal of Cancer (2011) vol. 2 pp. 331-332.
Porter et al., "Randomized, Phase II Dose Optimization Study of Chimeric Antigen Receptor Modified T Cells Directed Against CD19 (CTL019) in Patients with Relapsed, Refractory CLL" Blood (2014) vol. 124 No. 21.
Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Pyonteck et al., "CSF-1R inhibition alters macrophage polarization and blocks glioma progression." Natural Medicine (2013) vol. 19 No. 10 pp. 1264-1272.
Rapoport et al., "Restoration of immunity in lymphopenic individuals with cancer by vaccination and adoptive T-cell transfer" Nature Medicine (2005) vol. 11 No. 11 pp. 1320-1277.
Robak & Robak, "New Anti-CD20 Monoclonal Antibodies for the Treatment of B-Cell Lymphoid Malignancies" Biodrugs (2011) vol. 25 No. 1 pp. 13-25.
Roederer, "T-cell dynamics of immunodeficiency" Nature Medicine (1995) vol. 1 No. 7 pp. 621-622.
Romeo et al., "Cellular immunity to HIV activated by CD4 fused to T cell or Fc receptor polypeptides," Cell 64:1037-1046 (1991).
Romisher et al., "Bruton's Tyrosine Kinase Inhibition Is Associated with Manageable Cardiac Toxicity" Blood (2015) vol. 126 No. 23.
Rossolini et al. "Use of deoxyinosine-containing primers vs degenerate primers for polymerase chain reaction based on ambiguous sequence information" Molecular and Cellular Probes (1994) vol. 8, No. 2, pp. 91-98.
Rudikoff et al. "Single amino acid substitutuion altering antigen-binding specificity" Proc. Natl. Acad. Sci. (1982) vol. 79, pp. 1979-1983.
Ruella and Gill, "How to train your T cell: genetically engineered chimeric antigen receptor T cells versus bispecific T-cell engagers to target CD19 in B acute lymphoblastic leukemia." (2015) vol. 15 No. 6 pp. 761-766.
Ruella et al. "Novel Chimeric Antigen 3-35 Receptor T Cells for the Treatment of CD19-Negative Relapses Occurring after CD19-Targeted Irrenunotherapies" Blood (2014) vol. 124, p. 966.
Ruella et al., "Combination of Ibrutinib and Anti-CD19 Chimeric Antigen Receptor T Cells for the Treatment of Relapsing/Refractory Mantle Cell Lymphoma (MCL)" Haematologica (2015) vol. 100 pp. 287-288.
Ruella et al., "The Addition of the BTK Ibrutinib to Anti-CD19 Chimeric Antigen Receptor T Cells (CART19) Improve-Responses against Mantle Cell Lymphoma" Clinical Cancer Research (2016) 1-13.
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Sadelain et al., "Targeting Tumours with Genetically Enhanced T Lymphocytes," Nature Reviews: Cancer 3: 35-45 (2003).
Sagiv-Barfi, et al., "Ibrutinib enhances the antitumor immune response induced by intratumoral injection of a TLR9 ligand in mouse lymphoma" Blood, 125(13)2079-2086 (2015).

(56) References Cited

OTHER PUBLICATIONS

Sagiv-Barfi, et al., "Therapeutic antitumor immunity by checkpoint blockade is enhanced by ibrutinib, an inhibitor of both BTK and ITK" PNAS, 112(9):E966-E972 (2015).

Salvadori, "Antineoplastic effects of mammalian target of rapamycine inhibitors." World Journal of Transplantation (2012) vol. 2 No. 5 pp. 74-83.

Santoni et al., "Role of natural and adaptive immunity in renal cell carcinoma response to VEGFR-TKIs and mTOR inhibitor" International Journal of Cancer (2014) vol. 134 No. 12 pp. 2772-2777.

Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.

Scott et al., "Monoclonal antibodies in cancer therapy" Cancer Immunity (2012) vol. 12 p. 14.

Sebestyen et al., "Human TCR That Incorporate CD3 Induce Highly Preferred Pairing between TCR and Chains following Gene Transfer" Journal of Immunology (2008) vol. 180 pp. 7736-7746.

Shi et al. "Chimeric antigen receptor for adoptive immunotherapy of cancer: latest research and future prospects" Molecular Cancer (2014) vol. 13, No. 219, pp. 1-8.

Shirasu et al. "Functional Design of Chimeric T-Cell Antigen Receptors for Adoptive Immunotherapy of Cancer: Architecture and Outcomes" Anticancer Research (2012) vol. 32, pp. 2377-2384.

Shirasu et al., "Functional Design of Chimeric T-Cell Antigen Receptors for Adoptive Immunotherapy of Cancer: Architecture and Outcomes," AntiCancer Res. 32: 2377-2384 (2012).

Sidaway, "Ibrutinib supercharges CAR T cells" Nature Reviews Clinical Oncology (2016) Abstract.

Smith-Gill et al., "Contributions of Immunoglobulin Heavy and Light Chains to Antibody Specificity for Lysozyme and Two Haptens" The Journal of Immunology (1987) vol. 139, pp. 4135-4144.

Song et al. "CD27 costimulation augments the survival and antitumor activity of redirected human T cells in vivo" Blood (2012) vol. 119, No. 3, pp. 696-706.

Song et al. "Light Chain of Natural Antibody Plays a Dominant Role in Protein Antigen Binding" Biochemical and Biophysical Research Communications (2000) vol. 268, pp. 390-394.

Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.

Tammana Syam et al., "4-1BB and CD28 Signaling plays a synergistic role in redirecting umbibical cord blood T cells against B-cell malignancies" Human Gene Therapy (2010) vol. 21, pp. 75-86.

Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.

Trinh et al. "Optimization of codon pair use within the (GGGGS)3 linker sequence results in enhanced protein expression" Molecular Immunology (2004) vol. 40, pp. 717-722.

Uckun et al., "Detailed studies on expression and function of CD19 surface determinant by using B43 monoclonal antibody and the clinical potential of anti-CD19 immunotoxins" Blood (1988) vol. 71 pp. 13-29.

\* cited by examiner

NUCLEIC ACID MOLECULES ENCODING CHIMERIC ANTIGEN RECEPTORS COMPRISING A CD20 BINDING DOMAIN

RELATED APPLICATIONS

This application claims priority to U.S. Provisional Application No. 62/405,520 filed Oct. 7, 2016, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Jan. 8, 2018, is named N2067-712110_SL.txt and is 903,081 bytes in size.

FIELD OF THE INVENTION

The present invention relates generally to the use of T cells or natural killer (NK) cells engineered to express a Chimeric Antigen Receptor (CAR) to treat a disease associated with expression of the Cluster of Differentiation 20 protein (CD20) or Cluster of Differentiation 22 protein (CD22).

BACKGROUND OF THE INVENTION

Many patients with B cell malignancies are incurable with standard therapy. In addition, traditional treatment options often have serious side effects. Attempts have been made in cancer immunotherapy, however, several obstacles render this a very difficult goal to achieve clinical effectiveness. Although hundreds of so-called tumor antigens have been identified, these are generally derived from self and thus are poorly immunogenic. Furthermore, tumors use several mechanisms to render themselves hostile to the initiation and propagation of immune attack.

Recent developments using chimeric antigen receptor (CAR) modified autologous T cell (CART) therapy, which relies on redirecting T cells to a suitable cell-surface molecule on cancer cells such as B cell malignancies, show promising results in harnessing the power of the immune system to treat B cell malignancies and other cancers (see, e.g., Sadelain et al., Cancer Discovery 3:388-398 (2013)). The clinical results of the murine derived CART19 (i.e., "CTL019") have shown promise in establishing complete remissions in patients suffering with CLL as well as in childhood ALL (see, e.g., Kalos et al., Sci Transl Med 3:95ra73 (2011), Porter et al., NEJM 365:725-733 (2011), Grupp et al., NEJM 368:1509-1518 (2013)). Besides the ability for the chimeric antigen receptor on the genetically modified T cells to recognize and destroy the targeted cells, a successful therapeutic T cell therapy needs to have the ability to proliferate and persist over time, in order to survey for leukemic relapse. The variable quality of T cells, resulting from anergy, suppression, or exhaustion, will have effects on CAR-transformed T cells' performance, over which skilled practitioners have limited control at this time. To be effective, CAR transformed patient T cells need to persist and maintain the ability to proliferate in response to the cognate antigen. It has been shown that ALL patient T cells perform can do this with CART19 comprising a murine scFv (see, e.g., Grupp et al., NEJM 368:1509-1518 (2013)).

Thus, there is a need for further CAR therapies.

SUMMARY OF THE INVENTION

The disclosure features, at least in part, novel antigen binding domains and Chimeric Antigen Receptor (CAR) molecules directed to CD20 and CD22, as well as methods of use, e.g., as monotherapies or in combination therapies. In some embodiments, the compositions and method disclosed herein can comprise a combination of a CAR molecule that binds CD20 in combination with a B-cell inhibitor, for example, an inhibitor of CD19, or CD22, or a combination thereof. Nucleic acids encoding the compositions, host cells, vectors, as well as methods of making and using, are also disclosed.

Nucleic Acids Encoding CD20 Binding Domains and CD20 CARs

In a first aspect, the invention features an isolated nucleic acid molecule encoding a chimeric antigen receptor (CAR), wherein the CAR comprises an antibody or antibody fragment which includes a CD20 binding domain (e.g., a murine, human or humanized CD20 binding domain), a transmembrane domain, and an intracellular signaling domain (e.g., an intracellular signaling domain comprising a costimulatory domain and/or a primary signaling domain). In one embodiment, the CAR comprises an antibody or antibody fragment which includes a CD20 binding domain described herein (e.g., a murine, human or humanized CD20 binding domain described herein), a transmembrane domain described herein, and an intracellular signaling domain described herein (e.g., an intracellular signaling domain comprising a costimulatory domain and/or a primary signaling domain).

In one embodiment, the encoded CD20 binding domain comprises one or more (e.g., one or more, two or more, or all three) light chain complementarity determining region 1 (LCDR1), light chain complementarity determining region 2 (LCDR2), and light chain complementarity determining region 3 (LCDR3) of a CD20 binding domain described herein, and/or one or more (e.g., one or more, two or more, or all three) heavy chain complementarity determining region 1 (HCDR1), heavy chain complementarity determining region 2 (HCDR2), and heavy chain complementarity determining region 3 (HCDR3) of a CD20 binding domain described herein, e.g., a CD20 binding domain comprising one or more (e.g., one or more, two or more, or all three) LCDRs and one or more (e.g., one or more, two or more, or all three) HCDRs. In an embodiment, the encoded CD20 binding domain comprises a heavy chain CDR (e.g., HCDR1, HCDR2, and/or HCDR3) described herein, e.g., in Table 1 and summarized in Table 2. In an embodiment, the encoded CD20 binding domain comprises a light chain CDR (e.g., LCDR1, LCDR2, and/or LCDR3) described herein, e.g., in Table 1 and summarized in Table 3.

In some embodiment, the encoded CD20 binding domain comprises one, two, three, four, five, or six of the following amino acid sequences:

the HCDR1 comprises, or consists of, the amino acid sequence of (N/S)YN(L/M)H;

the HCDR2 comprises, or consists of, the amino acid sequence of (SEQ ID NO: 1075)
AIYPGN(Y/G)DTSYN(Q/P)KFKG;

the HCDR3 comprises, or consists of, the amino acid consensus sequence of (V/S)(D/Y)F(G/Y)(H/G)S(R/S)(Y/S)WYFDV; (SEQ ID NO: 1076)

the LCDR1 comprises, or consists of, the amino acid sequence of

RA(T/S)SSVSSM(N/H); (SEQ ID NO: 1077)

the LCDR2 comprises, or consists of, the amino acid sequence of ATSNLAS (SEQ ID NO: 1078); and/or the LCDR3 comprises, or consists of, the amino acid sequence of QQW(T/I)FNPPT (SEQ ID NO: 1079).

In one embodiment, the encoded CD20 binding domain (e.g., a murine, human or humanized CD20 binding domain) comprises a light chain variable region described herein (e.g., in Table 1 and summarized in Table 5) and/or a heavy chain variable region described herein (e.g., in Table 1 and summarized in Table 4). In one embodiment, the encoded CD20 binding domain is a scFv comprising a light chain and a heavy chain as set forth in of Table 1. In an embodiment, the encoded CD20 binding domain (e.g., an scFv) comprises or consists of an amino acid sequence in Table 1. In an embodiment, the CD20 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 5, or a sequence with 95-99% identity with an amino acid sequence of Table 5; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 4, or a sequence with 95-99% identity to an amino acid sequence of Table 4.

In one embodiment, the encoded CD20 binding domain includes a (Gly4-Ser)$_n$ linker, wherein n is 1, 2, 3, 4, 5, or 6, preferably 3 or 4 (SEQ ID NO: 1089). The light chain variable region and heavy chain variable region of a scFv can be, e.g., in any of the following orientations: light chain variable region-linker-heavy chain variable region or heavy chain variable region-linker-light chain variable region.

In one embodiment, the encoded CD20 binding domain comprises a sequence selected from a group consisting of SEQ ID NO: 159, SEQ ID NO: 240, SEQ ID NO: 24, SEQ ID NO: 51, SEQ ID NO: 78, SEQ ID NO: 105, SEQ ID NO: 132, SEQ ID NO: 186, SEQ ID NO: 213, SEQ ID NO: 267, SEQ ID NO: 294, SEQ ID NO: 321, SEQ ID NO: 348, SEQ ID NO: 375, SEQ ID NO: 402, and SEQ ID NO: 429, or a sequence with 95-99% identity thereof.

In one embodiment, the nucleic acid sequence encoding the CD20 binding domain comprises a sequence selected from a group consisting of SEQ ID NO: 160, SEQ ID NO: 241, SEQ ID NO: 25, SEQ ID NO: 52, SEQ ID NO: 79, SEQ ID NO: 106, SEQ ID NO: 133, SEQ ID NO: 187, SEQ ID NO: 214, SEQ ID NO: 268, SEQ ID NO: 295, SEQ ID NO: 322, SEQ ID NO: 349, SEQ ID NO: 376, SEQ ID NO: 403, and SEQ ID NO, or a sequence with 95-99% identity thereof. In an embodiment, the nucleic acid sequence encoding the CD20 binding domain comprises a sequence as set forth in Table 1.

In some embodiments, the isolated nucleic acid molecule encodes a CAR polypeptide comprising the amino acid sequence selected from the group consisting of SEQ ID NO: 161, SEQ ID NO: 242, SEQ ID NO: 26, SEQ ID NO: 53, SEQ ID NO: 80, SEQ ID NO: 107, SEQ ID NO: 134, SEQ ID NO: 188, SEQ ID NO: 215, SEQ ID NO: 269, SEQ ID NO: 296, SEQ ID NO: 323, SEQ ID NO: 350, SEQ ID NO: 377, SEQ ID NO: 404 and SEQ ID NO: 431, or a sequence with 95-99% identity thereof or an amino acid sequence comprising at least one, two or three modifications but not more than 30, 20, 10 or 5 modifications of an amino acid of SEQ ID NO: 161, SEQ ID NO: 242, SEQ ID NO: 26, SEQ ID NO: 53, SEQ ID NO: 80, SEQ ID NO: 107, SEQ ID NO: 134, SEQ ID NO: 188, SEQ ID NO: 215, SEQ ID NO: 269, SEQ ID NO: 296, SEQ ID NO: 323, SEQ ID NO: 350, SEQ ID NO: 377, SEQ ID NO: 404 and SEQ ID NO: 431, optionally wherein the CAR polypeptide does not include a signal peptide of MALPVTALLLPLALLLHAARP (SEQ ID NO: 1080).

In some embodiments, the isolated nucleic acid molecule encodes a CAR polypeptide comprising the amino acid sequence selected from the group consisting of SEQ ID NO: 161, SEQ ID NO: 242, SEQ ID NO: 26, SEQ ID NO: 53, SEQ ID NO: 80, SEQ ID NO: 107, SEQ ID NO: 134, SEQ ID NO: 188, SEQ ID NO: 215, SEQ ID NO: 269, SEQ ID NO: 296, SEQ ID NO: 323, SEQ ID NO: 350, SEQ ID NO: 377, SEQ ID NO: 404 and SEQ ID NO: 431, optionally wherein the CAR polypeptide does not include a signal peptide of MALPVTALLLPLALLLHAARP (SEQ ID NO: 1080).

In some embodiments, the isolated nucleic acid molecule comprises the nucleotide sequence selected from the group consisting of SEQ ID NO: 162, SEQ ID NO: 243, SEQ ID NO: 27, SEQ ID NO: 54, SEQ ID NO: 81, SEQ ID NO: 108, SEQ ID NO: 135, SEQ ID NO: 189, SEQ ID NO: 216, SEQ ID NO: 270, SEQ ID NO: 297, SEQ ID NO: 324, SEQ ID NO: 351, SEQ ID NO: 378, SEQ ID NO: 405 and SEQ ID NO: 432, or a sequence with 95-99% identity thereof, optionally wherein the CAR nucleic acid does not include a signal peptide sequence of

ATGGCCCTCCCTGTCACCGCCCTGCTGCTTCCGCTGGCTCTTCTGCTCCA (SEQ ID NO: 1081)

CGCCGCTCGGCCC.

In some embodiments, the isolated nucleic acid molecule comprises the nucleotide sequence selected from the group consisting of SEQ ID NO: 162, SEQ ID NO: 243, SEQ ID NO: 27, SEQ ID NO: 54, SEQ ID NO: 81, SEQ ID NO: 108, SEQ ID NO: 135, SEQ ID NO: 189, SEQ ID NO: 216, SEQ ID NO: 270, SEQ ID NO: 297, SEQ ID NO: 324, SEQ ID NO: 351, SEQ ID NO: 378, SEQ ID NO: 405 and SEQ ID NO: 432, optionally wherein the CAR nucleic acid does not include a signal peptide sequence of

ATGGCCCTCCCTGTCACCGCCCTGCTGCTTCCGCTGGCTCTTCTGCTCCA (SEQ ID NO: 1081)

CGCCGCTCGGCCC.

In one embodiment, the encoded CAR includes a transmembrane domain that comprises a transmembrane domain of a protein, e.g., a protein described herein, e.g., selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD123, CD134, CD137 and CD154. In one embodiment, the encoded transmembrane domain comprises a sequence of SEQ ID NO: 801. In one embodiment, the encoded transmembrane domain comprises an amino acid sequence comprises at least one, two or three modifications but not more than 20, 10 or 5 modifications of an amino acid sequence of SEQ ID NO: 801, or a sequence with 95-99% identity to an amino acid sequence of SEQ ID NO: 801. In one embodiment, the nucleic acid sequence encoding the transmembrane domain comprises a sequence of SEQ ID NO: 802, or a sequence with 95-99% identity thereof.

In one embodiment, the encoded CD20 binding domain is connected to the transmembrane domain by a hinge region, e.g., a hinge region described herein. In one embodiment, the encoded hinge region comprises SEQ ID NO: 799 or SEQ ID NO: 814, or a sequence with 95-99% identity thereof. In one embodiment, the nucleic acid sequence encoding the hinge region comprises a sequence of SEQ ID NO: 800 or SEQ ID NO: 815, or a sequence with 95-99% identity thereof.

In one embodiment, the isolated nucleic acid molecule further comprises a sequence encoding a costimulatory domain, e.g., a costimulatory domain described herein.

In embodiments, the intracellular signaling domain comprises a costimulatory domain. In embodiments, the intracellular signaling domain comprises a primary signaling domain. In embodiments, the intracellular signaling domain comprises a costimulatory domain and a primary signaling domain.

In one embodiment, the costimulatory domain is a functional signaling domain obtained from a protein, e.g., described herein, e.g., selected from the group consisting of OX40, CD2, CD27, CD28, CDS, ICAM-1, LFA-1 (CD11a/CD18), ICOS (CD278), and 4-1BB (CD137). In one embodiment, the costimulatory domain is selected from the group consisting of 4-1BB, CD27 or CD28. In one embodiment, the costimulatory domain comprises a sequence selected from the group consisting of SEQ ID NO: 803, SEQ ID NO: 818 or SEQ ID NO: 809. In one embodiment, the costimulatory domain comprises the sequence of SEQ ID NO: 803. In one embodiment, the costimulatory domain comprises an amino acid sequence having at least one, two or three modifications but not more than 20, 10 or 5 modifications of an amino acid sequence of SEQ ID NO: 803, or a sequence with 95-99% identity to an amino acid sequence of SEQ ID NO: 803. In one embodiment, the nucleic acid sequence encoding the costimulatory domain comprises a sequence of SEQ ID NO: 804, or a sequence with 95-99% identity thereof.

In embodiments, the primary signaling domain comprises a functional signaling domain of CD3 zeta. In embodiments, the functional signaling domain of CD3 zeta comprises SEQ ID NO: 805 or SEQ ID NO: 807.

In one embodiment, the encoded intracellular signaling domain comprises a functional signaling domain of 4-1BB and/or a functional signaling domain of CD3 zeta. In one embodiment, the encoded intracellular signaling domain comprises the sequence of SEQ ID NO: 803 and/or the sequence of SEQ ID NO: 805 or SEQ ID NO: 807. In one embodiment, the intracellular signaling domain comprises an amino acid sequence having at least one, two or three modifications but not more than 20, 10 or 5 modifications of an amino acid sequence of SEQ ID NO: 803 and/or the sequence of SEQ ID NO: 805 or SEQ ID NO: 807, or a sequence with 95-99% identity to an amino acid sequence of SEQ ID NO: 803 and/or the sequence of SEQ ID NO: 805 or SEQ ID NO: 807. In one embodiment, the encoded intracellular signaling domain comprises the sequence of SEQ ID NO: 803 and the sequence of SEQ ID NO: 805 or SEQ ID NO: 807, wherein the sequences comprising the intracellular signaling domain are expressed in the same frame and as a single polypeptide chain. In one embodiment, the nucleic acid sequence encoding the intracellular signaling domain comprises a sequence of SEQ ID NO: 804, or a sequence with 95-99% identity thereof, and/or a sequence of SEQ ID NO: 806 or SEQ ID NO: 808, or a sequence with 95-99% identity thereof.

In another aspect, the invention pertains to an isolated nucleic acid molecule encoding a CAR construct comprising a leader sequence, e.g., a leader sequence described herein, e.g., of SEQ ID NO: 797, a CD20 binding domain described herein, e.g., a CD20 binding domain comprising a LCDR1, a LCDR2, a LCDR3, a HCDR1, a HCDR2 and a HCDR3 described herein, e.g., a murine, human or humanized CD20 binding domain described in Table 1, or a sequence with 95-99% identify thereof, a hinge region described herein, e.g., of SEQ ID NO: 799, a transmembrane domain described herein, e.g., having a sequence of SEQ ID NO: 801, and an intracellular signaling domain, e.g., an intracellular signaling domain described herein. In one embodiment, the encoded intracellular signaling domain comprises a costimulatory domain, e.g., a costimulatory domain described herein, e.g., a 4-1BB costimulatory domain having a sequence of SEQ ID NO: 803, and/or a primary signaling domain, e.g., a primary signaling domain described herein, e.g., a CD3 zeta stimulatory domain having a sequence of SEQ ID NO: 805 or SEQ ID NO: 806. In one embodiment, the isolated nucleic acid molecule encoding the CAR construct includes a leader sequence encoded by the nucleic acid sequence of SEQ ID NO: 798, or a sequence with 95-99% identity thereto.

In some embodiments, the isolated nucleic acid molecule comprises (e.g., consists of) a nucleic acid encoding a CAR amino acid sequence described in Table 1.

In one embodiment, the isolated nucleic acid molecule comprises (e.g., consists of) a nucleic acid encoding a CAR amino acid sequence of SEQ ID NO: 26, SEQ ID NO: 53, SEQ ID NO: 80, SEQ ID NO: 107, SEQ ID NO: 134, SEQ ID NO: 161, SEQ ID NO: 188, SEQ ID NO: 215, SEQ ID NO: 242, SEQ ID NO: 269, SEQ ID NO: 296, SEQ ID NO: 323, SEQ ID NO: 350, SEQ ID NO: 377, SEQ ID NO: 404, and SEQ ID NO: 431, or an amino acid sequence having 85%, 90%, 95%, 96%, 97%, 98% or 99% identity to an amino acid sequence of SEQ ID NO: 26, SEQ ID NO: 53, SEQ ID NO: 80, SEQ ID NO: 107, SEQ ID NO: 134, SEQ ID NO: 161, SEQ ID NO: 188, SEQ ID NO: 215, SEQ ID NO: 242, SEQ ID NO: 269, SEQ ID NO: 296, SEQ ID NO: 323, SEQ ID NO: 350, SEQ ID NO: 377, SEQ ID NO: 404, and SEQ ID NO: 431.

In some embodiments, the isolated nucleic acid molecule comprises (e.g., consists of) a nucleic acid sequence described in Table 1.

In one embodiment, the isolated nucleic acid molecule comprises (e.g., consists of) a nucleic acid sequence of SEQ ID NO: 162, SEQ ID NO: 243, SEQ ID NO: 27, SEQ ID NO: 54, SEQ ID NO: 81, SEQ ID NO: 108, SEQ ID NO: 135, SEQ ID NO: 189, SEQ ID NO: 216, SEQ ID NO: 270, SEQ ID NO: 297, SEQ ID NO: 324, SEQ ID NO: 351, SEQ ID NO: 378, SEQ ID NO: 405, and SEQ ID NO: 432, or a nucleic acid sequence having 85%, 90%, 95%, 96%, 97%, 98% or 99% identity to a nucleic acid sequence of SEQ ID NO: 162, SEQ ID NO: 243, SEQ ID NO: 27, SEQ ID NO: 54, SEQ ID NO: 81, SEQ ID NO: 108, SEQ ID NO: 135, SEQ ID NO: 189, SEQ ID NO: 216, SEQ ID NO: 270, SEQ ID NO: 297, SEQ ID NO: 324, SEQ ID NO: 351, SEQ ID NO: 378, SEQ ID NO: 405, and SEQ ID NO: 432.

In one aspect, the invention pertains to an isolated nucleic acid molecule encoding a CD20 binding domain, wherein the CD20 binding domain comprises one or more (e.g., one or more, two or more, or all three) light chain complementarity determining region 1 (LCDR1), light chain complementarity determining region 2 (LCDR2), and light chain complementarity determining region 3 (LCDR3) of a CD20 binding domain described herein, and one or more (e.g., one or more, two or more, or all three) heavy chain complementarity determining region 1 (HCDR1), heavy chain complementarity determining region 2 (HCDR2), and heavy chain complementarity determining region 3 (HCDR3) of a CD20 binding domain described herein, e.g., a murine, human or humanized CD20 binding domain comprising one or more (e.g., one or more, two or more, or all three) LCDRs and one or more (e.g., one or more, two or more, or all three) HCDRs.

In some embodiments, the heavy chain CDR (e.g., HCDR1, HCDR2, and/or HCDR3) comprises an amino acid sequence described in Table 2 or set forth in Table 1. In some embodiments, the light chain CDR (e.g., LCDR1, LCDR2, and/or LCDR3) comprises an amino acid sequence described in Table 3 or set forth in Table 1.

In some embodiments, the amino acid sequence of the HCDR1, HCDR2, and HCDR3, respectively, is chosen from a)-p) of the following:
 (a) SEQ ID NOs: 136, 137, and 138;
 (b) SEQ ID NOs: 217, 218, and 219;
 (c) SEQ ID NOs: 55, 56, and 57;
 (d) SEQ ID NOs: 82, 83, and 84;
 (e) SEQ ID NOs: 109, 110, and 111;
 (f) SEQ ID NOs: 1, 2, and 3;
 (g) SEQ ID NOs: 163, 164, and 165;
 (h) SEQ ID NOs: 190, 191, and 192;
 (i) SEQ ID NOs: 28, 29, and 30;
 (j) SEQ ID NOs: 244, 245, and 246;
 (k) SEQ ID NOs: 271, 272, and 273;
 (l) SEQ ID NOs: 298, 299, and 300;
 (m) SEQ ID NOs: 325, 326, and 327;
 (n) SEQ ID NOs: 352, 353, and 354;
 (o) SEQ ID NOs: 379, 380, and 381; and
 (p) SEQ ID NOs: 406, 407, and 408.

In some embodiments, the amino acid sequence of the LCDR1, LCDR2, and LCDR3, respectively, is chosen from a)-p) of the following:
 (a) SEQ ID NOs: 147, 148, and 149;
 (b) SEQ ID NOs: 228, 229, and 230;
 (c) SEQ ID NOs: 66, 67, and 68;
 (d) SEQ ID NOs: 93, 94, and 95;
 (e) SEQ ID NOs: 120, 121, and 122;
 (f) SEQ ID NOs: 12, 13, and 14;
 (g) SEQ ID NOs: 174, 175, and 176;
 (h) SEQ ID NOs: 201, 202, and 203;
 (i) SEQ ID NOs: 39, 40, and 41;
 (j) SEQ ID NOs: 255, 256, and 257;
 (k) SEQ ID NOs: 282, 283, and 284;
 (l) SEQ ID NOs: 309, 310, and 311;
 (m) SEQ ID NOs: 336, 337, and 338;
 (n) SEQ ID NOs: 363, 364, and 365;
 (o) SEQ ID NOs: 390, 391, and 392; and
 (p) SEQ ID NOs: 417, 418, and 419.

In some embodiments, the amino acid sequence of the LCDR1, LCDR2, LCDR3, HCDR1, HCDR2, and HCDR3, respectively, is chosen from a)-p) of the following:
 (a) SEQ ID NOs: 147, 148, 149, 136, 137, and 138;
 (b) SEQ ID NOs: 228, 229, 230, 217, 218, and 219;
 (c) SEQ ID NOs: 66, 67, 68, 55, 56, and 57;
 (d) SEQ ID NOs: 93, 94, 95, 82, 83, and 84;
 (e) SEQ ID NOs: 120, 121, 122, 109, 110, and 111;
 (f) SEQ ID NOs: 12, 13, 14, 1, 2, and 3;
 (g) SEQ ID NOs: 174, 175, 176, 163, 164, and 165;
 (h) SEQ ID NOs: 201, 202, 203, 190, 191, and 192;
 (i) SEQ ID NOs: 39, 40, 41, 28, 29, and 30;
 (j) SEQ ID NOs: 255, 256, 257, 244, 245, and 246;
 (k) SEQ ID NOs: 282, 283, 284, 271, 272, and 273;
 (l) SEQ ID NOs: 309, 310, 311, 298, 299, and 300;
 (m) SEQ ID NOs: 336, 337, 338, 325, 326, and 327;
 (n) SEQ ID NOs: 363, 364, 365, 352, 353, and 354;
 (o) SEQ ID NOs: 390, 391, 392, 379, 380, and 381; and
 (p) SEQ ID NOs: 417, 418, 419, 406, 407, and 408.

In some embodiments, the amino acid sequence of the HCDR1, HCDR2, and HCDR3, respectively, is chosen from a)-p) of the following:
 a) SEQ ID NOs: 139, 140, and 141;
 b) SEQ ID NOs: 220, 221, and 222;
 c) SEQ ID NOs: 4, 5, and 6;
 d) SEQ ID NOs: 31, 32, and 33;
 e) SEQ ID NOs: 58, 59, and 60;
 f) SEQ ID NOs: 85, 86, and 87;
 g) SEQ ID NOs: 112, 113, and 114;
 h) SEQ ID NOs: 166, 167, and 168;
 i) SEQ ID NOs: 193, 194, and 195;
 j) SEQ ID NOs: 247, 248, and 249;
 k) SEQ ID NOs: 274, 275, and 276;
 l) SEQ ID NOs: 301, 302, and 303;
 m) SEQ ID NOs: 328, 329, and 330;
 n) SEQ ID NOs: 355, 356, and 357;
 o) SEQ ID NOs: 382, 383, and 384; and
 p) SEQ ID NOs: 409, 410, and 411.

In some embodiments, the encoded amino acid sequence of the LCDR1, LCDR2, and LCDR3, respectively, is chosen from a)-p) of the following:
 a) SEQ ID NOs: 150, 151, and 152;
 b) SEQ ID NOs: 231, 232, and 233;
 c) SEQ ID NOs: 15, 16, and 17;
 d) SEQ ID NOs: 42, 43, and 44;
 e) SEQ ID NOs: 69, 70, and 71;
 f) SEQ ID NOs: 96, 97, and 98;
 g) SEQ ID NOs: 123, 124, and 125;
 h) SEQ ID NOs: 177; 178, and 179;
 i) SEQ ID NOs: 204, 205, and 206;
 j) SEQ ID NOs: 258, 259, and 260;
 k) SEQ ID NOs: 285, 286, and 287;
 l) SEQ ID NOs: 312, 313, and 314;
 m) SEQ ID NOs: 339, 340, and 341;
 n) SEQ ID NOs: 366, 367, and 368;
 o) SEQ ID NOs: 393, 394, and 395; and
 p) SEQ ID NOs: 420, 421, and 422.

In some embodiments, the amino acid sequence of the LCDR1, LCDR2, LCDR3, HCDR1, HCDR2, and HCDR3, respectively, is chosen from a)-p) of the following:
 a) SEQ ID NOs: 150, 151, 152, 139, 140, and 141;
 b) SEQ ID NOs: 231, 232, 233, 220, 221, and 222;
 c) SEQ ID NOs: 15, 16, 17, 4, 5, and 6;
 d) SEQ ID NOs: 42, 43, 44, 31, 32, and 33;
 e) SEQ ID NOs: 69, 70, 71, 58, 59, and 60;
 f) SEQ ID NOs: 96, 97, 98, 85, 86, and 87;
 g) SEQ ID NOs: 123, 124, 125, 112, 113, and 114;
 h) SEQ ID NOs: 177; 178, 179, 166, 167, and 168;
 i) SEQ ID NOs: 204, 205, 206, 193, 194, and 195;
 j) SEQ ID NOs: 258, 259, 260, 247, 248, and 249;

k) SEQ ID NOs: 285, 286, 287, 274, 275, and 276;
l) SEQ ID NOs: 312, 313, 314, 301, 302, and 303;
m) SEQ ID NOs: 339, 340, 341, 328, 329, and 330;
n) SEQ ID NOs: 366, 367, 368, 355, 356, and 357;
o) SEQ ID NOs: 393, 394, 395, 382, 383, and 384; and
p) SEQ ID NOs: 420, 421, 422, 409, 410, and 411.

In some embodiments, the amino acid sequence of the HCDR1, HCDR2, and HCDR3, respectively, is chosen from a)-p) of the following:
a) SEQ ID NOs: 142, 143, and 144;
b) SEQ ID NOs: 223, 224, and 225;
c) SEQ ID NOs: 7, 8, and 9;
d) SEQ ID NOs: 34, 35, and 36;
e) SEQ ID NOs: 61, 62, and 63;
f) SEQ ID NOs: 88, 89, and 90;
g) SEQ ID NOs: 115, 116, and 117;
h) SEQ ID NOs: 169, 170, and 171;
i) SEQ ID NOs: 196, 197, and 198;
j) SEQ ID NOs: 250, 251, and 252;
k) SEQ ID NOs: 277, 278, and 279;
l) SEQ ID NOs: 304, 305, and 306;
m) SEQ ID NOs: 331, 332, and 333;
n) SEQ ID NOs: 358, 359, and 360;
o) SEQ ID NOs: 385, 386, and 387; and
p) SEQ ID NOs: 412, 413, and 414.

In some embodiments, the amino acid sequence of the LCDR1, LCDR2, and LCDR3, respectively, is chosen from a)-p) of the following:
a) SEQ ID NOs: 153, 154, and 155;
b) SEQ ID NOs: 234, 235, and 236;
c) SEQ ID NOs: 18, 19, and 20;
d) SEQ ID NOs: 45, 46, and 47;
e) SEQ ID NOs: 72, 73, and 74;
f) SEQ ID NOs: 99, 100, and 101;
g) SEQ ID NOs: 126, 127, and 128;
h) SEQ ID NOs: 180, 181, and 182;
i) SEQ ID NOs: 207, 208, and 209;
j) SEQ ID NOs: 261, 262, and 263;
k) SEQ ID NOs: 288, 289, and 290;
l) SEQ ID NOs: 315, 316, and 317;
m) SEQ ID NOs: 342, 343, and 344;
n) SEQ ID NOs: 369, 370, and 371;
o) SEQ ID NOs: 396, 397, and 398; and
p) SEQ ID NOs: 423, 424, and 425.

In some embodiments, the amino acid sequence of the LCDR1, LCDR2, LCDR3, HCDR1, HCDR2, and HCDR3, respectively, is chosen from a)-p) of the following:
a) SEQ ID NOs: 153, 154, 155, 142, 143, and 144;
b) SEQ ID NOs: 234, 235, 236, 223, 224, and 225;
c) SEQ ID NOs: 18, 19, 20, 7, 8, and 9;
d) SEQ ID NOs: 45, 46, 47, 34, 35, and 36;
e) SEQ ID NOs: 72, 73, 74, 61, 62, and 63;
f) SEQ ID NOs: 99, 100, 101, 88, 89, and 90;
g) SEQ ID NOs: 126, 127, 128, 115, 116, and 117;
h) SEQ ID NOs: 180, 181, 182, 169, 170, and 171;
i) SEQ ID NOs: 207, 208, 209, 196, 197, and 198;
j) SEQ ID NOs: 261, 262, 263, 250, 251, and 252;
k) SEQ ID NOs: 288, 289, 290, 277, 278, and 279;
l) SEQ ID NOs: 315, 316, 317, 304, 305, and 306;
m) SEQ ID NOs: 342, 343, 344, 331, 332, and 333;
n) SEQ ID NOs: 369, 370, 371, 358, 359, and 360;
o) SEQ ID NOs: 396, 397, 398, 385, 386, and 387; and
p) SEQ ID NOs: 423, 424, 425, 412, 413, and 414.

In an embodiment, the encoded CD20 binding domain (e.g., scFv) comprises an amino acid sequence described in Table 1.

In one embodiment, the encoded CD20 binding domain comprises a light chain variable region described herein (e.g. Table 5) and/or a heavy chain variable region described herein (e.g. Table 4). In one embodiment, the encoded CD20 binding domain is a scFv comprising a light chain and a heavy chain of an amino acid sequence selected from Table 1.

In an embodiment, the amino acid sequence of the light chain variable region and the heavy chain variable region, respectively, is chosen from a) to p) of the following:
(a) SEQ ID NOs: 156 and 145;
(b) SEQ ID NOs: 237 and 226;
(c) SEQ ID NOs: 21 and 10
(d) SEQ ID NOs: 75 and 64;
(e) SEQ ID NOs: 102 and 91;
(f) SEQ ID NOs: 129 and 118;
(g) SEQ ID NOs: 183 and 172;
(h) SEQ ID NOs: 210 and 199;
(i) SEQ ID NOs: 48 and 37;
(j) SEQ ID NOs: 264 and 253;
(k) SEQ ID NOs: 291 and 280;
(l) SEQ ID NOs: 318 and 307;
(m) SEQ ID NOs: 345 and 334;
(n) SEQ ID NOs: 372 and 361;
(o) SEQ ID NOs: 399 and 388; and
(p) SEQ ID NOs: 426 and 415.

In an embodiment, the CD20 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided Table 5, or a sequence with 95-99% identity with an amino acid sequence of Table 5; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 4, or a sequence with 95-99% identity to an amino acid sequence in Table 4.

In one embodiment, the CD20 binding domain comprises a sequence selected from a group consisting of those shown in Table 2, Table 3, Table 4, or Table 5, or a sequence with 95-99% identify thereof.

In one embodiment, the encoded CD20 binding domain is a scFv, and a light chain variable region comprising an amino acid sequence described herein, e.g., in Table 1 or is attached to a heavy chain variable region comprising an amino acid sequence described herein, e.g., in Table 1, via a linker, e.g., a linker described herein. In one embodiment, the encoded CD20 binding domain includes a $(Gly_4\text{-}Ser)_n$ linker, wherein n is 1, 2, 3, 4, 5, or 6, preferably 4 (SEQ ID NO: 1089). The light chain variable region and heavy chain variable region of a scFv can be, e.g., in any of the following orientations: light chain variable region-linker-heavy chain variable region or heavy chain variable region-linker-light chain variable region.

Polypeptides Comprising CD20 Binding Domains and CD20 CARs

In another aspect, the invention pertains to an isolated polypeptide molecule encoded by the nucleic acid molecule. In one embodiment, the isolated polypeptide molecule comprises a sequence selected from the group consisting of SEQ ID NO: 159, SEQ ID NO: 240, SEQ ID NO: 24, SEQ ID NO: 51, SEQ ID NO: 78, SEQ ID NO: 105, SEQ ID NO: 132, SEQ ID NO: 186, SEQ ID NO: 213, SEQ ID NO: 267, SEQ ID NO: 294, SEQ ID NO: 321, SEQ ID NO: 348, SEQ ID NO: 375, SEQ ID NO: 402, and SEQ ID NO: 429, or a sequence with 95-99% identify thereof.

In another aspect, the invention pertains to an isolated chimeric antigen receptor (CAR) molecule comprising a CD20 binding domain (e.g., a murine, human or humanized antibody or antibody fragment that specifically binds to CD20), a transmembrane domain, and an intracellular signaling domain (e.g., an intracellular signaling domain comprising a costimulatory domain and/or a primary signaling domain). In one embodiment, the CAR comprises an antibody or antibody fragment which includes a CD20 binding domain described herein (e.g., a murine, human or humanized antibody or antibody fragment that specifically binds to CD20 as described herein), a transmembrane domain described herein, and an intracellular signaling domain described herein (e.g., an intracellular signaling domain comprising a costimulatory domain and/or a primary signaling domain described herein).

In embodiments, provided herein is an isolated CAR molecule comprising a CD20 binding domain, a transmembrane domain, and an intracellular signaling domain, wherein the CD20 binding domain comprises one or more light chain complementarity determining region 1 (LCDR1), light chain complementarity determining region 2 (LCDR2), and light chain complementarity determining region 3 (LCDR3) of any CD20 binding domain listed in Table 1, and one or more heavy chain complementarity determining region 1 (HCDR1), heavy chain complementarity determining region 2 (HCDR2), and heavy chain complementarity determining region 3 (HCDR3) of any CD20 binding domain listed in Table 1.

In one embodiment, the CD20 binding domain comprises one or more (e.g., one or more, two or more, or all three) light chain complementarity determining region 1 (LCDR1), light chain complementarity determining region 2 (LCDR2), and light chain complementarity determining region 3 (LCDR3) of a CD20 binding domain described herein, and one or more (e.g., one or more, two or more, or all three) heavy chain complementarity determining region 1 (HCDR1), heavy chain complementarity determining region 2 (HCDR2), and heavy chain complementarity determining region 3 (HCDR3) of a CD20 binding domain described herein, e.g., a CD20 binding domain comprising one or more (e.g., one or more, two or more, or all three) LCDRs and one or more (e.g., one or more, two or more, or all three) HCDRs. In some embodiments, the heavy chain CDR (e.g., HCDR1, HCDR2, and/or HCDR3) comprises an amino acid sequence described in Table 2 or set forth in Table 1. In some embodiments, the light chain CDR (e.g., LCDR1, LCDR2, and/or LCDR3) comprises an amino acid sequence described in Table 3 or set forth in Table 1.

In one embodiment, the CD20 binding domain comprises a light chain variable region described herein (e.g., in Table 5) and/or a heavy chain variable region described herein (e.g., in Table 4). In one embodiment, the CD20 binding domain is a scFv comprising a light chain and a heavy chain of an amino acid sequence listed in Table 4 or Table 5. In an embodiment, the CD20 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 5, or a sequence with 95-99% identity with an amino acid sequence provided in Table 5; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 4, or a sequence with 95-99% identity to an amino acid sequence provided in Table 4. In one embodiment, the CD20 binding domain comprises a sequence selected from a group consisting of SEQ ID NO: 159, SEQ ID NO: 240, SEQ ID NO: 24, SEQ ID NO: 51, SEQ ID NO: 78, SEQ ID NO: 105, SEQ ID NO: 132, SEQ ID NO: 186, SEQ ID NO: 213, SEQ ID NO: 267, SEQ ID NO: 294, SEQ ID NO: 321, SEQ ID NO: 348, SEQ ID NO: 375, SEQ ID NO: 402, and SEQ ID NO: 429 or a sequence with 95-99% identify thereof. In one embodiment, the CD20 binding domain is a scFv, and a light chain variable region comprising an amino acid sequence described herein, e.g., in Table 5, is attached to a heavy chain variable region comprising an amino acid sequence described herein, e.g., in Table 4, via a linker, e.g., a linker described herein. In one embodiment, the CD20 binding domain includes a $(Gly_4\text{-}Ser)_n$ linker, wherein n is 1, 2, 3, 4, 5, or 6, preferably 4 (SEQ ID NO: 1089). The light chain variable region and heavy chain variable region of a scFv can be, e.g., in any of the following orientations: light chain variable region-linker-heavy chain variable region or heavy chain variable region-linker-light chain variable region.

In one embodiment, the isolated CAR molecule comprises a transmembrane domain of a protein, e.g., a protein described herein, e.g., selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD123, CD134, CD137 and CD154. In one embodiment, the transmembrane domain comprises a sequence of SEQ ID NO: 801. In one embodiment, the transmembrane domain comprises an amino acid sequence having at least one, two or three modifications (e.g., substitutions) but not more than 20, 10 or 5 modifications (e.g., substitutions) of an amino acid sequence of SEQ ID NO: 801, or a sequence with 95-99% identity to an amino acid sequence of SEQ ID NO: 801.

In one embodiment, the CD20 binding domain is connected to the transmembrane domain by a hinge region, e.g., a hinge region described herein. In one embodiment, the encoded hinge region comprises SEQ ID NO: 799, or a sequence with 95-99% identity thereof.

In one embodiment, the isolated CAR molecule further comprises a sequence encoding a costimulatory domain, e.g., a costimulatory domain described herein.

In embodiments, the intracellular signaling domain of the isolated CAR molecule comprises a costimulatory domain. In embodiments, the intracellular signaling domain of the isolated CAR molecule comprises a primary signaling domain. In embodiments, the intracellular signaling domain of the isolated CAR molecule comprises a costimulatory domain and a primary signaling domain.

In one embodiment, the costimulatory domain comprises a functional signaling domain of a protein selected from the group consisting of OX40, CD2, CD27, CD28, CDS, ICAM-1, LFA-1 (CD11a/CD18), ICOS (CD278) and 4-1BB (CD137). In one embodiment, the costimulatory domain comprises a sequence of SEQ ID NO: 803. In one embodiment, the costimulatory domain comprises an amino acid sequence having at least one, two or three modifications (e.g., substitutions) but not more than 20, 10 or 5 modifications (e.g., substitutions) of an amino acid sequence of SEQ ID NO: 803, or a sequence with 95-99% identity to an amino acid sequence of SEQ ID NO: 803.

In embodiments, the primary signaling domain comprises a functional signaling domain of CD3 zeta. In embodiments, the functional signaling domain of CD3 zeta comprises SEQ ID NO: 805 or SEQ ID NO: 807.

In one embodiment, the intracellular signaling domain comprises a functional signaling domain of 4-1BB and/or a functional signaling domain of CD3 zeta. In one embodiment, the intracellular signaling domain comprises the sequence of SEQ ID NO: 803 and/or the sequence of SEQ ID NO: 805 or SEQ ID NO: 807. In one embodiment, the intracellular signaling domain comprises an amino acid sequence having at least one, two or three modifications (e.g., substitutions) but not more than 20, 10 or 5 modifications (e.g., substitutions) of an amino acid sequence of SEQ ID NO: 803 and/or the sequence of SEQ ID NO: 805 or SEQ ID NO: 807, or a sequence with 95-99% identity to an amino acid sequence of SEQ ID NO: 803 and/or the sequence of SEQ ID NO: 805 or SEQ ID NO: 807. In one embodiment, the intracellular signaling domain comprises the sequence of SEQ ID NO: 803 and/or the sequence of SEQ ID NO: 805 or SEQ ID NO: 807, wherein the sequences comprising the intracellular signaling domain are expressed in the same frame and as a single polypeptide chain.

In one embodiment, the isolated CAR molecule further comprises a leader sequence, e.g., a leader sequence described herein. In one embodiment, the leader sequence comprises an amino acid sequence of SEQ ID NO: 797, or a sequence with 95-99% identity to an amino acid sequence of SEQ ID NO: 797.

In another aspect, the invention pertains to an isolated CAR molecule comprising a leader sequence, e.g., a leader sequence described herein, e.g., a leader sequence of SEQ ID NO: 797, or having 95-99% identity thereof, a CD20 binding domain described herein, e.g., a CD20 binding domain comprising a LCDR1, a LCDR2, a LCDR3, a HCDR1, a HCDR2 and a HCDR3 described herein, e.g., a CD20 binding domain described in Table 1, or a sequence with 95-99% identify thereof, a hinge region, e.g., a hinge region described herein, e.g., a hinge region of SEQ ID NO: 799, or having 95-99% identity thereof, a transmembrane domain, e.g., a transmembrane domain described herein, e.g., a transmembrane domain having a sequence of SEQ ID NO: 801 or a sequence having 95-99% identity thereof, an intracellular signaling domain, e.g., an intracellular signaling domain described herein (e.g., an intracellular signaling domain comprising a costimulatory domain and/or a primary signaling domain). In one embodiment, the intracellular signaling domain comprises a costimulatory domain, e.g., a costimulatory domain described herein, e.g., a 4-1BB costimulatory domain having a sequence of SEQ ID NO: 803, or having 95-99% identity thereof, and/or a primary signaling domain, e.g., a primary signaling domain described herein, e.g., a CD3 zeta stimulatory domain having a sequence of SEQ ID NO: 805 or SEQ ID NO: 807, or having 95-99% identity thereof. In one embodiment, the intracellular signaling domain comprises a costimulatory domain, e.g., a costimulatory domain described herein, e.g., a 4-1BB costimulatory domain having a sequence of SEQ ID NO: 803, and/or a primary signaling domain, e.g., a primary signaling domain described herein, e.g., a CD3 zeta stimulatory domain having a sequence of SEQ ID NO: 805 or SEQ ID NO: 807.

In one embodiment, the isolated CAR molecule comprises (e.g., consists of) an amino acid sequence of SEQ ID NO: 159, SEQ ID NO: 240, SEQ ID NO: 24, SEQ ID NO: 51, SEQ ID NO: 78, SEQ ID NO: 105, SEQ ID NO: 132, SEQ ID NO: 186, SEQ ID NO: 213, SEQ ID NO: 267, SEQ ID NO: 294, SEQ ID NO: 321, SEQ ID NO: 348, SEQ ID NO: 375, SEQ ID NO: 402, and SEQ ID NO: 429, or an amino acid sequence having at least one, two, three, four, five, 10, 15, 20 or 30 modifications (e.g., substitutions) but not more than 60, 50 or 40 modifications (e.g., substitutions) of an amino acid sequence of SEQ ID NO: 159, SEQ ID NO: 240, SEQ ID NO: 24, SEQ ID NO: 51, SEQ ID NO: 78, SEQ ID NO: 105, SEQ ID NO: 132, SEQ ID NO: 186, SEQ ID NO: 213, SEQ ID NO: 267, SEQ ID NO: 294, SEQ ID NO: 321, SEQ ID NO: 348, SEQ ID NO: 375, SEQ ID NO: 402, and SEQ ID NO: 429, or an amino acid sequence having 85%, 90%, 95%, 96%, 97%, 98% or 99% identity to an amino acid sequence of SEQ ID NO: 159, SEQ ID NO: 240, SEQ ID NO: 24, SEQ ID NO: 51, SEQ ID NO: 78, SEQ ID NO: 105, SEQ ID NO: 132, SEQ ID NO: 186, SEQ ID NO: 213, SEQ ID NO: 267, SEQ ID NO: 294, SEQ ID NO: 321, SEQ ID NO: 348, SEQ ID NO: 375, SEQ ID NO: 402, and SEQ ID NO: 429.

In one aspect, the invention pertains to a CD20 binding domain comprising one or more (e.g., one or more, two or more, or all three) light chain complementarity determining region 1 (LCDR1), light chain complementarity determining region 2 (LCDR2), and light chain complementarity determining region 3 (LCDR3) of a CD20 binding domain described herein, and one or more (e.g., one or more, two or more, or all three) heavy chain complementarity determining region 1 (HCDR1), heavy chain complementarity determining region 2 (HCDR2), and heavy chain complementarity determining region 3 (HCDR3) of a CD20 binding domain described herein, e.g., a CD20 binding domain comprising one or more, e.g., all three, LCDRs and one or more, e.g., all three, HCDRs.

In one embodiment, the CD20 binding domain comprises a light chain variable region described herein (e.g. Table 5) and/or a heavy chain variable region described herein (e.g. Table 4). In one embodiment, the CD20 binding domain is a scFv comprising a light chain amino acid sequence from Table 5 and a heavy chain of an amino acid sequence from Table 4. In an embodiment, the CD20 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided, in Table 5 or a sequence with 95-99% identity with an amino acid sequence in Table 5; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 4, or a sequence with 95-99% identity to an amino acid sequence in Table 4. In one embodiment, the CD20 binding domain comprises a sequence selected from a group consisting of SEQ ID NO: 159, SEQ ID NO: 240, SEQ ID NO: 24, SEQ ID NO: 51, SEQ ID NO: 78, SEQ ID NO: 105, SEQ ID NO: 132, SEQ ID NO: 186, SEQ ID NO: 213, SEQ ID NO: 267, SEQ ID NO: 294, SEQ ID NO: 321, SEQ ID NO: 348, SEQ ID NO: 375, SEQ ID NO: 402, and SEQ ID NO: 429, or a sequence with 95-99% identify thereof. In one embodiment, the CD20 binding domain is a scFv, and a light chain variable region comprising an amino acid sequence described herein, e.g., in Table 5, is attached to a heavy chain variable region comprising an amino acid sequence described herein, e.g., in Table 4, via a linker, e.g., a linker described herein. In one embodiment, the CD20 binding domain includes a $(Gly_4\text{-}Ser)_n$ linker, wherein n is 1, 2, 3, 4, 5, or 6, preferably 4 (SEQ ID NO: 1089). The light chain variable region and heavy chain variable region of a scFv can be, e.g., in any of the following orientations: light chain variable region-linker-heavy chain variable region or heavy chain variable region-linker-light chain variable region.

Also provided herein is a CD20 binding domain or polypeptide, e.g., comprising a CD20 binding scFv described herein and, e.g., further comprising a leader sequence described herein. For example, the leader sequence comprises or consists of SEQ ID NO: 797. In some embodiments, the CD20 binding domain comprises a sequence selected from the group consisting of SEQ ID NO: 159, SEQ ID NO: 240, SEQ ID NO: 24, SEQ ID NO: 51, SEQ ID NO: 78, SEQ ID NO: 105, SEQ ID NO: 132, SEQ ID NO: 186, SEQ ID NO: 213, SEQ ID NO: 267, SEQ ID NO: 294, SEQ ID NO: 321, SEQ ID NO: 348, SEQ ID NO: 375, SEQ ID NO: 402, and SEQ ID NO: 429. In some embodiments, the CD20 binding domain comprises a soluble scFv amino acid sequence listed in Table 1. In an embodiment, the CD20 binding domain is encoded by a soluble scFv nucleic acid sequence listed in Table 1.

CD22 Binding Domains and CD22 CARs

In another aspect, the invention pertains to a CD22 binding domain, or a CAR molecule, comprising the amino acid sequence of the heavy chain variable domain (VH) of CD22-65sKD, e.g., comprising the amino acid sequence of SEQ ID NO: 839; and/or the amino acid sequence of the light chain variable domain (VL) of CD22-65sKD, e.g., comprising the amino acid sequence of SEQ ID NO: 840. In embodiments, the VH and VL sequences are connected directly, e.g., without a linker. In embodiments, the VH and VL sequences are connected via a linker. In some embodiments, the linker is a (Gly4-Ser)n linker, wherein n is 0, 1, 2, 3, 4, 5, or 6 (SEQ ID NO: 1082). In some embodiments, there is no linker between the VH region of CD22-65sKD and the VL region of CD22-65KD, e.g., n is 0. In one embodiment, the linker is a (Gly4-Ser)n linker, wherein n is 1 (SEQ ID NO: 1083). In some embodiments, the CD22 binding domain comprises the amino acid sequence of CD22-65sKD scFv, e.g., comprising the amino acid sequence of SEQ ID NO: 837.

In another aspect, the invention pertains to a CD22 binding domain, or a CAR molecule, comprising the amino acid sequence of an scFv of CD22-65s (a (Gly4-Ser)n linker, wherein n is 1 (SEQ ID NO: 1083)) or CD22-65ss (no linker). In some embodiments, the CD22 binding domain comprises the scFv of SEQ ID NO: 835. In some embodiments, the CD22 binding domain comprises the scFv of SEQ ID NO: 836.

The invention also pertains to nucleic acid molecules, vectors, cells and uses comprising any of the foregoing aspects or embodiments.

Linkers for Antigen Binding Domains

It was found that CAR molecules comprising a short or no linker between the variable domains (e.g., VH and VL) of the antigen binding domain showed equal to, or greater, activity than longer versions of the linker. For example, in some embodiments, CD22-65s (having (Gly4-Ser)n linker, wherein n is 1 (SEQ ID NO: 1083)) shows comparable or greater activity and/or efficacy in a tumor model, compared to CD22-65 (having (Gly4-Ser)n linker, wherein n is 3 (SEQ ID NO: 1084)), see e.g., Examples 9 and 12. Accordingly, any of the antigen binding domains or CAR molecules described herein can have a linker connecting the variable domains of the antigen binding domain of varying lengths, including for example, a short linker of about 3 to 6 amino acids, 4 to 5 amino acids, or about 5 amino acids. In some embodiments, a longer linker can be used, e.g., about 6 to 35 amino acids, e.g., 8 to 32 amino acids, 10 to 30 amino acids, 10 to 20 amino acids. For example, a (Gly4-Ser)n linker, wherein n is 0, 1, 2, 3, 4, 5, or 6 can be used (SEQ ID NO: 1082). In one embodiment, the variable domains are not connected via a linker, e.g., (Gly4-Ser)n linker, n=0. In some embodiments, the variable domains are connected via a short linker, e.g., (Gly4-Ser)n linker, n=1 (SEQ ID NO: 1083). In some embodiments, the variable domains are connected via a (Gly4-Ser)n linker, n=2 (SEQ ID NO: 1085). In some embodiments, the variable domains are connected via a (Gly4-Ser)n linker, n=3 (SEQ ID NO: 1084). In some embodiments, the variable domains are connected via a (Gly4-Ser)n linker, n=4 (SEQ ID NO: 1086). In some embodiments, the variable domains are connected via a (Gly4-Ser)n linker, n=5 (SEQ ID NO: 1087). In some embodiments, the variable domains are connected via a (Gly4-Ser)n linker, n=6 (SEQ ID NO: 1088). The order of the variable domain, e.g., in which the VL and VH domains appear in the antigen binding domain, e.g., scFv, can be varied (i.e., VL-VH, or VH-VL orientation). In one embodiment, the antigen binding domain binds to CD20, e.g., a CD20 antigen binding domain as described herein. In another embodiment, the antigen binding domain binds to CD22, e.g., a CD22 antigen binding domain as described herein. In another embodiment, the antigen binding domain binds to CD19, e.g., a CD19 antigen binding domain as described herein.

The invention also pertains to nucleic acid molecules, vectors, cells and uses comprising any of the foregoing aspects or embodiments.

Multispecific Antibody Molecules and CARs

In some embodiments, the antibody molecule is a multispecific, e.g., bispecific, antibody molecule having a first binding specificity for a first antigen, e.g., a B-cell epitope, and a second binding specificity for the same or a different antigen, e.g., B cell epitope. In one embodiment, the first and second binding specificity is an antibody molecule, e.g., an antibody binding domain (e.g., a scFv). Within each antibody molecule (e.g., scFv) of a bispecific antibody molecule, the VH can be upstream or downstream of the VL.

In some embodiments, the upstream antibody or antibody fragment (e.g., scFv) is arranged with its VH (VH$_1$) upstream of its VL (VL$_1$) and the downstream antibody or antibody fragment (e.g., scFv) is arranged with its VL (VL$_2$) upstream of its VH (VH$_2$), such that the overall bispecific antibody molecule has the arrangement VH$_1$-VL$_1$-VL$_2$-VH$_2$, from an N- to C-terminal orientation.

In some embodiments, the upstream antibody or antibody fragment (e.g., scFv) is arranged with its VL (VL$_1$) upstream of its VH (VH$_1$) and the downstream antibody or antibody fragment (e.g., scFv) is arranged with its VH (VH$_2$) upstream of its VL (VL$_2$), such that the overall bispecific antibody molecule has the arrangement VL$_1$-VH$_1$-VH$_2$-VL$_2$, from an N- to C-terminal orientation.

In some embodiments, the upstream antibody or antibody fragment (e.g., scFv) is arranged with its VL (VL$_1$) upstream of its VH (VH$_1$) and the downstream antibody or antibody fragment (e.g., scFv) is arranged with its VL (VL$_2$) upstream of its VH (VH$_2$), such that the overall bispecific antibody molecule has the arrangement VL$_1$-VH$_1$-VL$_2$-VH$_2$, from an N- to C-terminal orientation.

In yet some embodiments, the upstream antibody or antibody fragment (e.g., scFv) is arranged with its VH (VH$_1$) upstream of its VL (VL$_1$) and the downstream antibody or antibody fragment (e.g., scFv) is arranged with its VH (VH$_2$) upstream of its VL (VL$_2$), such that the overall bispecific antibody molecule has the arrangement VH$_1$-VL$_1$-VH$_2$-VL$_2$, from an N- to C-terminal orientation.

In any of the aforesaid configurations, optionally, a linker is disposed between the two antibodies or antibody fragments (e.g., scFvs), e.g., between $VL_1$ and $VL_2$ if the construct is arranged as $VH_1$-$VL_1$-$VL_2$-$VH_2$; between $VH_1$ and $VH_2$ if the construct is arranged as $VL_1$-$VH_1$-$VH_2$-$VL_2$; between $VH_1$ and $VL_2$ if the construct is arranged as $VL_1$-$VH_1$-$VL_2$-$VH_2$; or between $VL_1$ and $VH_2$ if the construct is arranged as $VH_1$-$VL_1$-$VH_2$-$VL_2$. In general, the linker between the two scFvs should be long enough to avoid mispairing between the domains of the two scFvs. The linker may be a linker as described herein. In some embodiments, the linker is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 841). In some embodiments, the linker is $(Gly_4$-$Ser)_n$, wherein n=4 (SEQ ID NO: 23). In some embodiments, the linker comprises, e.g., consists of, the amino acid sequence: LAEAAAK (SEQ ID NO: 1091).

In any of the aforesaid configurations, optionally, a linker is disposed between the VL and VH of the first scFv. Optionally, a linker is disposed between the VL and VH of the second scFv. In constructs that have multiple linkers, any two or more of the linkers can be the same or different. Accordingly, in some embodiments, a bispecific CAR comprises VLs, VHs, and optionally one or more linkers in an arrangement as described herein.

In some embodiments, each antibody molecule, e.g., each antigen binding domain (e.g., each scFv) comprises a linker between the VH and the VL regions. In some embodiments, the linker between the VH and the VL regions is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 1084). In some embodiments, the linker is $(Gly_4$-$Ser)_n$, wherein n=4 (SEQ ID NO: 23). In some embodiments, the VH and VL regions are connected without a linker.

In certain embodiments, the antibody molecule is a bispecific antibody molecule having a first binding specificity for a first B-cell epitope and a second binding specificity for the same or a different B-cell antigen. For instance, in some embodiments the bispecific antibody molecule has a first binding specificity for CD20 and a second binding specificity for one or more of CD10, CD19, CD20, CD22, CD34, CD123, FLT-3, ROR1, CD79b, CD179b, or CD79a. In some embodiments the bispecific antibody molecule has a first binding specificity for CD19 and a second binding specificity for CD20. In some embodiments the bispecific antibody molecule has a first binding specificity for CD19 and a second binding specificity for CD22.

In one embodiment, the antibody molecule is a bispecific antibody molecule having a binding specificity, e.g., a first and/or second binding specificity, to CD19. In one embodiment, the binding specificity is configured with its VL ($VL_1$) upstream of its VH ($VH_1$) and the downstream antibody or antibody fragment (e.g., scFv) is arranged with its VL ($VL_2$) upstream of its VH ($VH_2$), such that the overall bispecific antibody molecule has the arrangement $VL_1$-$VH_1$-$VL_2$-$VH_2$, from an N- to C-terminal orientation. In one embodiment, the CD19 binding specificity comprises a VH and VL as depicted in Table 11, e.g., a CTL019 scFv (SEQ ID NO: 765). In some embodiments, the CD19 binding specificity comprises a VH and VL as depicted in Table 11, e.g., a humanized CD19 scFv, e.g., a humanized CAR2. In some embodiments, the first and/or second binding specificity, to CD19 (e.g., first and/or second scFv to CD19) comprises a linker between the VH and the VL regions. In some embodiments, the linker between the VH and the VL regions is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 1084). In some embodiments, the linker is $(Gly_4$-$Ser)_n$, wherein n=4 (SEQ ID NO: 23). In some embodiments, the VH and VL regions are connected without a linker.

In another embodiment, the binding specificity, e.g., a first and/or second binding specificity, to CD19 is configured with its VL ($VL_1$) upstream of its VH ($VH_1$) and the downstream antibody or antibody fragment (e.g., scFv) is arranged with its VH ($VH_2$) upstream of its VL ($VL_2$), such that the overall bispecific antibody molecule has the arrangement $VL_1$-$VH_1$-$VH_2$-$VL_2$, from an N- to C-terminal orientation. In one embodiment, the CD19 binding specificity comprises a VH and VL as depicted in Table 11, e.g., a CTL019 scFv (SEQ ID NO: 765). In some embodiments, the CD19 binding specificity comprises a VH and VL as depicted in Table 11, e.g., a humanized CD19 scFv, e.g., a humanized CAR2. In some embodiments, the first and/or second binding specificity, to CD19 (e.g., first and/or second scFv to CD19) comprises a linker between the VH and the VL regions. In some embodiments, the linker between the VH and the VL regions is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 1084). In some embodiments, the linker is $(Gly_4$-$Ser)_n$, wherein n=4 (SEQ ID NO: 23). In some embodiments, the VH and VL regions are connected without a linker.

In another embodiment, the binding specificity, e.g., a first and/or second binding specificity, to CD19 is configured with its VH ($VH_1$) upstream of its VL ($VL_1$) and the downstream antibody or antibody fragment (e.g., scFv) is arranged with its VL ($VL_2$) upstream of its VH ($VH_2$), such that the overall bispecific antibody molecule has the arrangement $VH_1$-$VL_1$-$VL_2$-$VH_2$, from an N- to C-terminal orientation. In one embodiment, the CD19 binding specificity comprises a VH and VL as depicted in Table 11, e.g., a CTL019 scFv (SEQ ID NO: 765). In some embodiments, the CD19 binding specificity comprises a VH and VL as depicted in Table 11, e.g., a humanized CD19 scFv, e.g., a humanized CAR2. In some embodiments, the first and/or second binding specificity, to CD19 (e.g., first and/or second scFv to CD19) comprises a linker between the VH and the VL regions. In some embodiments, the linker between the VH and the VL regions is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 1084). In some embodiments, the linker is $(Gly_4$-$Ser)_n$, wherein n=4 (SEQ ID NO: 23). In some embodiments, the VH and VL regions are connected without a linker.

In another embodiment, the binding specificity, e.g., a first and/or second binding specificity, to CD19 is configured with its VH ($VH_1$) upstream of its VL ($VL_1$) and the downstream antibody or antibody fragment (e.g., scFv) is arranged with its VH (VH$_2$) upstream of its VL (VL$_2$), such that the overall bispecific antibody molecule has the arrangement VH$_1$-VL$_1$-VH$_2$-VL$_2$, from an N- to C-terminal orientation. In one embodiment, the CD19 binding specificity comprises a VH and VL as depicted in Table 11, e.g., a CTL019 scFv (SEQ ID NO: 765). In some embodiments, the CD19 binding specificity comprises a VH and VL as depicted in Table 11, e.g., a humanized CD19 scFv, e.g., a humanized CAR2. In some embodiments, the first and/or second binding specificity, to CD19 (e.g., first and/or second scFv to CD19) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the antibody molecule is a bispecific antibody molecule having a binding specificity, e.g., a first and/or second binding specificity, to CD20. In one embodiment, the binding specificity is configured with its VL (VL$_1$) upstream of its VH (VH$_1$) and the downstream antibody or antibody fragment (e.g., scFv) is arranged with its VL (VL$_2$) upstream of its VH (VH$_2$), such that the overall bispecific antibody molecule has the arrangement VL$_1$-VH$_1$-VL$_2$-VH$_2$, from an N- to C-terminal orientation. In one embodiment, the CD20 binding specificity comprises a VH and VL as depicted in Table 1, e.g., a VH and VL from a C3H2 scFv or a C5H1 scFv. In some embodiments, the first and/or second binding specificity, to CD20 (e.g., first and/or second scFv to CD20) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the binding specificity, e.g., a first and/or second binding specificity, to CD20 is configured with its VL (VL$_1$) upstream of its VH (VH$_1$) and the downstream antibody or antibody fragment (e.g., scFv) is arranged with its VH (VH$_2$) upstream of its VL (VL$_2$), such that the overall bispecific antibody molecule has the arrangement VL$_1$-VH$_1$-VH$_2$-VL$_2$, from an N- to C-terminal orientation. In one embodiment, the CD20 binding specificity comprises a VH and VL as depicted in Table 1, e.g., a VH and VL from a C3H2 scFv or a C5H1 scFv. In some embodiments, the first and/or second binding specificity, to CD20 (e.g., first and/or second scFv to CD20) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the binding specificity, e.g., a first and/or second binding specificity, to CD20 is configured with its VH (VH$_1$) upstream of its VL (VL$_1$) and the downstream antibody or antibody fragment (e.g., scFv) is arranged with its VL (VL$_2$) upstream of its VH (VH$_2$), such that the overall bispecific antibody molecule has the arrangement VH$_1$-VL$_1$-VL$_2$-VH$_2$, from an N- to C-terminal orientation. In one embodiment, the CD22 binding specificity comprises a VH and VL as depicted in Table 1, e.g., a VH and VL from a C3H2 scFv or a C5H1 scFv. In some embodiments, the first and/or second binding specificity, to CD20 (e.g., first and/or second scFv to CD20) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the binding specificity, e.g., a first and/or second binding specificity, to CD20 is configured with its VH (VH$_1$) upstream of its VL (VL$_1$) and the downstream antibody or antibody fragment (e.g., scFv) is arranged with its VH (VH$_2$) upstream of its VL (VL$_2$), such that the overall bispecific antibody molecule has the arrangement VH$_1$-VL$_1$-VH$_2$-VL$_2$, from an N- to C-terminal orientation. In one embodiment, the CD22 binding specificity comprises a VH and VL as depicted in Table 1, e.g., a VH and VL from a C3H2 scFv or a C5H1 scFv. In some embodiments, the first and/or second binding specificity, to CD20 (e.g., first and/or second scFv to CD20) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the antibody molecule is a bispecific antibody molecule having a binding specificity, e.g., a first and/or second binding specificity, to CD22. In one embodiment, the binding specificity is configured with its VL (VL$_1$) upstream of its VH (VH$_1$) and the downstream antibody or antibody fragment (e.g., scFv) is arranged with its VL (VL$_2$) upstream of its VH (VH$_2$), such that the overall bispecific antibody molecule has the arrangement VL$_1$-VH$_1$-VL$_2$-VH$_2$, from an N- to C-terminal orientation. In one embodiment, the CD22 binding specificity comprises a VH and VL as depicted in Table 6, e.g., a VH and VL from a CD22-65 or CD22-65KD scFv. In some embodiments, the first and/or second binding specificity, to CD22 (e.g., first and/or second scFv to CD22) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In another embodiment, the binding specificity, e.g., a first and/or second binding specificity, to CD22 is configured with its VL (VL$_1$) upstream of its VH (VH$_1$) and the downstream antibody or antibody fragment (e.g., scFv) is arranged with its VH (VH$_2$) upstream of its VL (VL$_2$), such that the overall bispecific antibody molecule has the arrangement VL$_1$-VH$_1$-VH$_2$-VL$_2$, from an N- to C-terminal orientation. In one embodiment, the CD22 binding specificity comprises a VH and VL as depicted in Table 6, e.g., a VH and VL from a CD22-65 or CD22-65KD scFv. In some embodiments, the first and/or second binding specificity, to CD22 (e.g., first and/or second scFv to CD22) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In another embodiment, the binding specificity, e.g., a first and/or second binding specificity, to CD22 is configured with its VH (VH$_1$) upstream of its VL (VL$_1$) and the downstream antibody or antibody fragment (e.g., scFv) is arranged with its VL (VL$_2$) upstream of its VH (VH$_2$), such that the overall bispecific antibody molecule has the arrangement VH$_1$-VL$_1$-VL$_2$-VH$_2$, from an N- to C-terminal orientation. In one embodiment, the CD22 binding specificity comprises a VH and VL as depicted in Table 6, e.g., a VH and VL from a CD22-65 or CD22-65KD scFv. In some embodiments, the first and/or second binding specificity, to CD22 (e.g., first and/or second scFv to CD22) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In another embodiment, the binding specificity, e.g., a first and/or second binding specificity, to CD22 is configured with its VH (VH$_1$) upstream of its VL (VL$_1$) and the downstream antibody or antibody fragment (e.g., scFv) is arranged with its VH (VH$_2$) upstream of its VL (VL$_2$), such that the overall bispecific antibody molecule has the arrangement VH$_1$-VL$_1$-VH$_2$-VL$_2$, from an N- to C-terminal orientation. In one embodiment, the CD22 binding specificity comprises a VH and VL as depicted in Table 6, e.g., a VH and VL from a CD22-65 or CD22-65KD scFv. In some embodiments, the first and/or second binding specificity, to CD22 (e.g., first and/or second scFv to CD22) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In some embodiments, the bispecific antibody molecule comprises a first binding specificity to CD19, e.g., any of the binding specificities to CD19 described herein, and a second binding specificity to CD22, e.g., any of the binding specificities to CD22 as described herein. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises the amino acid sequence: LAEAAAK (SEQ ID NO: 1091).

In one embodiment, the bispecific antibody molecule comprises a first binding specificity to CD19, e.g., a VL1-VH1 binding specificity to CD19, and a second binding specificity to CD22, e.g., a VL2-VH2 or VH2-VL1 binding specificity to CD22. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises the amino acid sequence: LAEAAAK (SEQ ID NO: 1091).

In one embodiment, the bispecific antibody molecule comprises a first binding specificity to CD22, e.g., a VL2-VH2 or VH2-VL1 binding specificity to CD22, and a second binding specificity to CD19, e.g., a VL1-VH1 binding specificity to CD19. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises the amino acid sequence: LAEAAAK (SEQ ID NO: 1091).

Two or more antibody molecules, e.g., as described herein, can be linked providing multispecific antibody molecules, e.g., bi-, tri or more antibody molecules.

In some embodiments, any of the aforesaid multispecific, e.g., bispecific, antibody molecules is present in a CAR molecule as described herein. In embodiments, CAR molecule comprises a bispecific CAR comprising a first and second binding specificities, e.g., as described herein (e.g., two antibody molecules, e.g., two scFvs as described herein). In some embodiments, the bispecific CAR comprises two antibody molecules, wherein the first binding specificity, e.g., the first antibody molecule (e.g., the first antigen binding domain, e.g., the first scFv) is closer to the transmembrane domain, also referred to herein as the proximal antibody molecule (e.g., proximal antigen binding domain) and the second binding specificity, e.g., the second antibody molecule (e.g., second antigen binding domain, e.g., the second scFv) is further away from the membrane, also referred to herein as the distal antibody molecule (e.g., the distal antigen binding domain). Thus, from N-to-C-terminus, the CAR molecule comprises a distal binding specificity, e.g., a distal antibody molecule (e.g., a distal antigen binding domain, e.g., a distal scFv or scFv2), optionally, a linker, followed by a proximal binding specificity, e.g., a proximal antibody molecule (e.g., a proximal antigen binding domain, e.g., a proximal scFv or scFv1), optionally via a linker, to a transmembrane domain and an intracellular domain, e.g., as described herein. A schematic of a bispecific CAR configuration is depicted in FIG. 27.

In some embodiments, CAR molecule comprises a bispecific CAR comprising a first and second binding specificities. In some embodiments, the bispecific CAR comprises a first binding specificity for a B-cell epitope and a second binding specificity for the same or a different B-cell antigen. For instance, in some embodiments, the bispecific CAR molecule has a first binding specificity for CD19 and a second binding specificity for one or more of CD19, CD22, CD10, CD20, CD34, CD123, FLT-3, ROR1, CD79b, CD179b, or CD79a. In some embodiments the bispecific CAR molecule has a first binding specificity for CD19 and a second binding specificity for CD20. In some embodiments the bispecific CAR molecule has a first binding specificity for CD19 and a second binding specificity for CD22.

In some embodiments, the CAR molecule comprises a proximal or distal binding specificity for CD20, e.g., a CD20 binding specificity as described herein.

In some embodiments, the CAR molecule comprises a proximal or distal binding specificity for CD22, e.g., a CD22 binding specificity as described herein.

In one embodiment, the CAR molecule comprises a distal to the membrane binding specificity to CD19, e.g., a VL1-VH1 binding specificity to CD19, and a proximal to the membrane binding specificity to CD22, e.g., a VL2-VH2 or VH2-VL1 binding specificity to CD22. In one embodiment, the first and second binding specificity are in a contiguous polypeptide chain, e.g., a single chain. In some embodiments, the first and second binding specificities, optionally, comprise a linker as described herein. In some embodiments, the linker is a $(Gly_4\text{-}Ser)_n$ linker, wherein n is 1, 2, 3, 4, 5, or 6 (SEQ ID NO: 1089). In some embodiments, the linker is $(Gly_4\text{-}Ser)_n$, wherein n=1 (SEQ ID NO: 1083), e.g., the linker has the amino acid sequence $Gly_4$-Ser (SEQ ID NO: 1090). In some embodiments, the linker is $(Gly_4\text{-}Ser)_n$, wherein n=3 (SEQ ID NO: 841). In some embodiments, the linker is $(Gly_4\text{-}Ser)_n$, wherein n=4 (SEQ ID NO: 23). In some embodiments, the linker comprises the amino acid sequence: LAEAAAK (SEQ ID NO: 1091). In one embodiment, the CAR molecule comprises a distal to the membrane binding specificity to CD19, e.g., a VL1-VH1 binding specificity to CD19, optionally, a $Gly_4$-Ser linker (SEQ ID NO: 1090) or a LAEAAAK linker (SEQ ID NO: 1091). In embodiments, the CD22 binding specificity comprises a CD22 VH and VL, wherein the linker between the VH and the VL regions is a $(Gly_4\text{-}Ser)_n$ linker, wherein n is 1, 2, 3, 4, 5, or 6 (SEQ ID NO: 1089). In some embodiments, the linker is $(Gly_4\text{-}Ser)_n$, wherein n=1 (SEQ ID NO: 1083), e.g., the linker has the amino acid sequence $Gly_4$-Ser (SEQ ID NO: 1090), e.g., as in the CD22-65s scFv. In some embodiments, the linker is $(Gly_4\text{-}Ser)_n$, wherein n=3 (SEQ ID NO: 1084), e.g., as in the CD22-65 scFv. In some embodiments, the linker is $(Gly_4\text{-}Ser)_n$, wherein n=4 (SEQ ID NO: 23). In some embodiments, the VH and VL regions are connected without a linker, e.g., as in the CD22-65ss scFv.

In one embodiment, the CAR molecule comprises a proximal to the membrane binding specificity to CD19, e.g., a VL1-VH1 binding specificity to CD19, and a distal to the membrane binding specificity to CD22, e.g., a VL2-VH2 or VH2-VL1 binding specificity to CD22. In one embodiment, the first and second binding specificity are in a contiguous polypeptide chain, e.g., a single chain. In some embodiments, the first and second binding specificities, optionally, comprise a linker as described herein. In some embodiments, the linker is a $(Gly_4\text{-}Ser)_n$ linker, wherein n is 1, 2, 3, 4, 5, or 6 (SEQ ID NO: 1089). In some embodiments, the linker is $(Gly_4\text{-}Ser)_n$, wherein n=1 (SEQ ID NO: 1083), e.g., the linker has the amino acid sequence $Gly_4$-Ser (SEQ ID NO: 1090). In some embodiments, the linker is $(Gly_4\text{-}Ser)_n$, wherein n=3 (SEQ ID NO: 841). In some embodiments, the linker is $(Gly_4\text{-}Ser)_n$, wherein n=4 (SEQ ID NO: 23). In some embodiments, the linker comprises the amino acid sequence: LAEAAAK (SEQ ID NO: 1091). In one embodiment, the CAR molecule comprises a proximal to the membrane binding specificity to CD19, e.g., a VL1-VH1 binding specificity to CD19, optionally, a $Gly_4$-Ser linker (SEQ ID NO: 1090) or a LAEAAAK linker (SEQ ID NO: 1091). In embodiments, the CD22 binding specificity comprises a CD22 VH and VL, wherein the linker between the VH and the VL regions is a $(Gly_4\text{-}Ser)_n$ linker, wherein n is 1, 2, 3, 4, 5, or 6 (SEQ ID NO: 1089). In some embodiments, the linker is $(Gly_4\text{-}Ser)_n$, wherein n=1 (SEQ ID NO: 1083), e.g., the linker has the amino acid sequence $Gly_4$-Ser (SEQ ID NO: 1090), e.g., as in the CD22-65s scFv. In some embodiments, the linker is $(Gly_4\text{-}Ser)_n$, wherein n=3 (SEQ ID NO: 1084), e.g., as in the CD22-65 scFv. In some embodiments, the linker is $(Gly_4\text{-}Ser)_n$, wherein n=4 (SEQ ID NO: 23). In some embodiments, the VH and VL regions are connected without a linker, e.g., as in the CD22-65ss scFv.

In some embodiments, the CAR molecule comprises a proximal or distal binding specificity for CD20, e.g., a CD20 binding specificity as described herein.

In one embodiment, the CAR molecule comprises a distal to the membrane binding specificity to CD19, e.g., a VL1-VH1 binding specificity to CD19, and a proximal to the membrane binding specificity to CD20, e.g., a VL2-VH2 or VH2-VL1 binding specificity to CD20. In one embodiment, the first and second binding specificity are in a contiguous polypeptide chain, e.g., a single chain. In some embodiments, the first and second binding specificities, optionally, comprise a linker as described herein. In some embodiments, the linker is a $(Gly_4\text{-}Ser)_n$ linker, wherein n is 1, 2, 3, 4, 5, or 6 (SEQ ID NO: 1089). In some embodiments, the linker is $(Gly_4\text{-}Ser)_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises the amino acid sequence: LAEAAAK (SEQ ID NO: 1091).

In some embodiments, the CAR molecule comprises a proximal or distal binding specificity for CD20, e.g., a CD20 binding specificity as described herein. In one embodiment, the CAR molecule comprises a proximal to the membrane binding specificity to CD19, e.g., a VL1-VH1 binding specificity to CD19, and a distal to the membrane binding specificity to CD20, e.g., a VL2-VH2 or VH2-VL1 binding specificity to CD20. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises the amino acid sequence: LAEAAAK (SEQ ID NO: 1091). In some embodiments, the linker consists of the amino acid sequence: LAEAAAK (SEQ ID NO: 1091).

In some embodiments, the CAR molecule comprises a proximal to the membrane binding specificity to CD19, e.g., a VL1-VH1 binding specificity to CD19, and a distal to the membrane binding specificity to CD20, e.g., a VL2-VH2 or VH2-VL2 binding specificity to CD20.

In some embodiments, the CAR molecule comprises a distal to the membrane binding specificity to CD19, e.g., a VL1-VH1 binding specificity to CD19, and a proximal to the membrane binding specificity to CD20, e.g., a VL2-VH2 or VH2-VL2 binding specificity to CD20.

In some embodiments, the CAR molecule further comprises human sequence leader, e.g., a human CD8alpha sequence at the N-terminus.

In some embodiments, the multispecific antibody molecule comprises the amino acid sequence of any of SEQ ID NOs: 845, 847, 849, 851, 853, 855, 857. 858, 860, 862, 864, 866, 868, 870, 872, or 874, or a sequence substantially identical thereto (e.g., at least 85%, 90%, 95%, 98%, 99% or more identical thereto).

In some embodiments, the multispecific antibody molecules consists of the amino acid sequence of any of SEQ ID NOs: 845, 847, 849, 851, 853, 855, 857. 858, 860, 862, 864, 866, 868, 870, 872, or 874, or a sequence substantially identical thereto (e.g., at least 85%, 90%, 95%, 98%, 99% or more identical thereto).

The invention also pertains to nucleic acid molecules, vectors, cells and uses comprising any of the foregoing aspects or embodiments.

Vectors

In another aspect, the invention pertains to a vector comprising any of the nucleic acid molecules described herein, e.g., a nucleic acid molecule encoding a CAR described herein. In one embodiment, the vector is selected from the group consisting of a DNA, a RNA, a plasmid, a lentivirus vector, adenoviral vector, or a retrovirus vector.

In one embodiment, the vector is a lentivirus vector. In one embodiment, the vector further comprises a promoter. In one embodiment, the promoter is an EF-1 alpha promoter. In one embodiment, the EF-1 alpha promoter comprises a sequence of SEQ ID NO: 833.

In one embodiment, the vector is an in vitro transcribed vector, e.g., a vector that transcribes RNA of a nucleic acid molecule described herein. In one embodiment, the nucleic acid sequence in the vector further comprises a poly(A) tail, e.g., a poly A tail described herein, e.g., comprising about 150 adenosine bases. In one embodiment, the nucleic acid sequence in the vector further comprises a 3'UTR, e.g., a 3' UTR described herein, e.g., comprising at least one repeat of a 3'UTR derived from human beta-globulin. In one embodiment, the nucleic acid sequence in the vector further comprises promoter, e.g., a T2A promoter.

In an embodiment, a nucleic acid sequence encoding a cleavable peptide, e.g., a P2A or F2A sequence, is disposed between the nucleic acid sequence encoding a first CAR molecule (e.g., CD20, CD22, or CD19) and a second CAR molecule (e.g., CD20, CD22, or CD19). In an embodiment, a sequence encoding an IRES, e.g., an EMCV or EV71 IRES, is disposed between the nucleic acid sequence encoding a first CAR molecule and a second CAR molecule sequence. In these embodiments, the first CAR and the second CAR are transcribed as a single RNA.

CAR Combinations

In another aspect, the invention features a nucleic acid encoding: (i) a CD20 CAR molecule, e.g., as described herein, and (ii) a CAR molecule that binds a B-cell antigen, e.g., CD19, CD22, CD10, CD34, CD123, FLT-3, ROR-1, CD79b, CD79a, or CD179b.

In another aspect, the invention features a nucleic acid encoding: (i) a first nucleic acid encoding a CD20 CAR molecule, e.g., as described herein, and (ii) a second nucleic acid encoding a CAR molecule that binds a B-cell antigen, e.g., CD19, CD22, CD10, CD34, CD123, FLT-3, ROR-1, CD79b, CD79a, or CD179b.

In some embodiments, the CAR molecule that binds a B-cell antigen is CD19 or CD22.

In some embodiments, the CAR binds to CD19 and comprises a nucleotide sequence encoding a CD19 CAR according to Table 11, e.g., CTL-019 or humanized CAR2.

In some embodiments, the CAR binds to CD22 and comprises a nucleotide sequence encoding a CD22 CAR according to Table 6, e.g., CD22-65 CAR, CD22-65KD CAR, CD22-65s CAR or CD22-65ss CAR.

In some embodiments, a nucleotide sequence encoding a cleavable peptide, e.g., a P2A or F2A sequence, is disposed between the nucleic acid molecule encoding the CD20 CAR and the nucleic acid molecule encoding the CAR that binds a B-cell antigen.

In some embodiments, the CD20 CAR and the CAR that binds a B-cell antigen are encoded by a single promoter, e.g., as a bicistronic transcription product.

In some embodiments, the single promoter is an EF-1α promoter, optionally wherein the EF-1α promoter comprises a sequence of SEQ ID NO: 833.

In some embodiments, the CD20 CAR is encoded by a first promoter and the CAR that binds a B-cell antigen is encoded by a second promoter.

In some embodiments, the nucleic acid comprises RNA or DNA.

In another aspect, the invention pertains to a polypeptide molecule encoded by, or comprising, any of the nucleic acid molecules as described herein.

Cells

In another aspect, the invention pertains to a cell, e.g., a population of immune effector cells, comprising a nucleic acid, an isolated polypeptide, or a vector described herein.

In some embodiments, the cell, e.g., the population of immune effector cells, comprises one or more, e.g., a first, a second and/or third, CAR molecules, wherein the CAR molecule is chosen from a CD19 CAR, a CD20 CAR or a CD22 CAR, or a combination of two, or three thereof.

In some embodiments, the cell comprises a CD19 CAR and a CD20 CAR of the invention.

In some embodiments, the cell comprises a CD19 CAR and a CD22 CAR of the invention.

In some embodiments, the cell comprises a CD20 CAR of the invention and a CD22 CAR of the invention.

In some embodiments, the cell comprises two CARs, e.g., a CD22 CAR of the invention, a CD20 CAR of the invention and a CD19 CAR).

In some embodiments, the one or more CAR molecules are present in the same cell.

In some embodiments, the one or more CAR molecules are present in different cells.

In one embodiment, the cell is a cell described herein, e.g., a human T cell or a human NK cell, e.g., a human T cell described herein. In one embodiment, the human T cell is a CD8+ T cell.

In another aspect, the invention pertains to a cell, e.g., a population of immune effector cells (e.g., a first and/or second population of immune effector cells), including: (i) a first cell population comprising the nucleic acid, the isolated polypeptide molecule, or the vector described herein.

In some embodiments, the CAR that binds a B-cell antigen is CD19 or CD22.

In one embodiment, the CAR binds to CD19 and comprises a nucleotide sequence encoding a CD19 CAR according to Table 11, e.g., CTL-019 or humanized CAR2.

In one embodiment, the CAR binds to CD22 and comprises a nucleotide sequence encoding a CD22 CAR according to Table 6, e.g., CD22-65 CAR, CD22-65KD CAR, CD22-65s CAR or CD22-65ss CAR.

In another embodiment, the CAR-expressing cell described herein can further express another agent, e.g., an agent which enhances the activity of a CAR-expressing cell. For example, in one embodiment, the agent can be an agent which inhibits an inhibitory molecule. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGF beta. In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta, or a fragment of any of these (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

Methods of Making and Uses

In another aspect, the invention pertains to a method of making a cell comprising transducing a cell described herein, e.g., a T cell or NK cell described herein, with a vector of comprising a nucleic acid encoding a CAR, e.g., a CAR described herein.

The present invention also provides a method of generating a population of RNA-engineered cells, e.g., cells described herein, e.g., T cells or NK cells, transiently expressing exogenous RNA. The method comprises introducing an in vitro transcribed RNA or synthetic RNA into a cell, where the RNA comprises a nucleic acid encoding a CAR molecule described herein.

In another aspect, the invention pertains to a method of providing an anti-tumor immunity in a mammal comprising administering to the mammal an effective amount of a cell expressing a CAR molecule, e.g., a cell expressing a CAR molecule described herein, e.g., a CD20 CAR molecule. In one embodiment, the cell is an autologous T cell or NK cell. In one embodiment, the cell is an allogeneic T cell or NK cell. In one embodiment, the mammal is a human.

In another aspect, the invention pertains to a cell, e.g., a population of immune effector cells, including, e.g., expressing, a CAR molecule as described herein, e.g., a CD20 CAR molecule, for use in a method of providing an anti-tumor immunity in a mammal, in which the method includes administering to the mammal an effective amount of the cell.

In another aspect, the invention pertains to a method of treating a mammal having a cancer, or a disease associated with expression of a B cell antigen as described herein, e.g., CD20, CD19, or CD22, e.g., wild type or mutant CD20, CD19, or CD22, (e.g., a proliferative disease, a precancerous condition, and a noncancer related indication associated with the expression of CD20, CD19, or CD22), comprising administering to the mammal an effective amount of the cells expressing a CAR molecule, e.g., a CAR molecule described herein, e.g., a CD20 CAR molecule. In some embodiments, the CD20 CAR-expressing cells, e.g., T cells or NK cells, engineered to express a CD20 CAR, e.g., are administered in combination with one or more B-cell inhibitors to treat a disease associated with expression of CD20. For example, a CD20 CAR-expressing cell is administered in combination with one or more additional B-cell inhibitors. In some embodiments, the B-cell inhibitor is a second CD20 inhibitor. In some embodiments, the B-cell inhibitor is an inhibitor of one or more of CD19, CD22, CD20, CD10, CD34, CD123, FLT-3, ROR1, CD79b, CD179b, or CD79a.

In another aspect, the invention pertains a cell, e.g., a population of immune effector cells, expressing a CAR molecule as described herein, e.g., a CD20 CAR molecule, for use in a method of treating a mammal having a cancer or a disease associated with expression of CD20, CD19, or CD22, in which the method includes administering to the mammal an effective amount of the cell. In some embodiments, the CD20 cells, e.g., T cells or NK cells, engineered to express a CD20 CAR, e.g., are administered in combination with one or more B-cell inhibitors to treat a disease associated with expression of CD20. For example, a CD20 CAR-expressing cell is administered in combination with one or more additional B-cell inhibitors. In some embodiments, the B-cell inhibitor is a second CD20 inhibitor. In some embodiments, the B-cell inhibitor is an inhibitor of one or more of CD19, CD22, CD20, CD10, CD34, CD123, FLT-3, ROR1, CD79b, CD179b, or CD79a.

In one embodiment, the disease associated with CD20, CD19, or CD22, expression is selected from a proliferative disease such as a cancer or malignancy or a precancerous condition such as a myelodysplasia, a myelodysplastic syndrome or a preleukemia, or is a non-cancer related indication associated with expression of CD20, CD19, or CD22.

In one embodiment, the cancer or disease associated with CD20, CD19, or CD22 is a hematologic cancer. For example, the hematological cancer is leukemia or lymphoma. In another example, the hematological cancer is chosen from one or more acute leukemias including but not limited to B-cell acute lymphoid leukemia (BALL), T-cell acute lymphoid leukemia (TALL), small lymphocytic leukemia (SLL), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to mantle cell lymphoma (MCL), B cell prolymphocytic leukemia, blastic plasmacytoid dendritic cell neoplasm, Burkitt's lymphoma, diffuse large B cell lymphoma (DLBCL), follicular lymphoma, hairy cell leukemia, small cell- or a large cell-follicular lymphoma, malignant lymphoproliferative conditions, MALT lymphoma, Marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia. In some embodiments, the disease is a "preleukemia" which is a diverse collection of hematological conditions united by ineffective production (or dysplasia) of myeloid blood cells.

In some embodiments, the cancer or disease associated with CD20, CD19, or CD22 expression includes but is not limited to atypical and/or non-classical cancers, malignancies, precancerous conditions or proliferative diseases expressing CD20, CD19, or CD22; and any combination thereof.

In some embodiments, the cancer or CD20-, CD19-, or CD22-associated disease is a B cell malignancy, such as non-Hodgkin lymphomas, e.g., DLBCL, follicular lymphoma; or CLL.

In one embodiment, the cells expressing a CAR molecule, e.g., a CAR molecule described herein, are administered in combination with an agent that increases the efficacy of a cell expressing a CAR molecule, e.g., an agent described herein. In embodiments, the agent is an mTOR inhibitor, e.g., an mTOR inhibitor as described herein.

In one embodiment, the cells expressing a CAR molecule, e.g., a CAR molecule described herein, are administered in combination with an agent that ameliorates one or more side effect associated with administration of a cell expressing a CAR molecule, e.g., an agent described herein.

In one embodiment, the cells expressing a CAR molecule, e.g., a CAR molecule described herein, are administered in combination with an agent that treats the disease associated with CD20, e.g., an agent described herein.

In another aspect, the invention pertains to the isolated nucleic acid molecule encoding a CAR of the invention, the isolated polypeptide molecule of a CAR of the invention, the vector comprising a CAR of the invention, the cell (or cell population) comprising a CAR of the invention, for use as a medicament, e.g., as described herein.

In another aspect, the invention pertains to the isolated nucleic acid molecule encoding a CAR of the invention, the isolated polypeptide molecule of a CAR of the invention, the vector comprising a CAR of the invention, the cell (or cell population) comprising a CAR of the invention, for use in the treatment of a disease expressing CD20, CD19, or CD22, e.g., a disease expressing CD20, CD19, or CD22 as described herein.

In another aspect, the invention relates to the method or use of cells, e.g., T cells or NK cells, engineered to express a CD20 CAR, e.g., in combination with one or more B-cell inhibitors to treat a disease associated with expression of CD20. For example, a CD20 CAR-expressing cell is administered in combination with one or more additional B-cell inhibitors. In some embodiments, the B-cell inhibitor is a second CD20 inhibitor. In some embodiments, the B-cell inhibitor is an inhibitor of one or more of CD19, CD22, CD20, CD10, CD34, CD123, FLT-3, ROR1, CD79b, CD179b, or CD79a.

In some embodiments, the B-cell inhibitor is a small molecule inhibitor; a polypeptide, e.g., a soluble ligand, an antibody, or antigen-binding fragment thereof that binds to a B-cell antigen (e.g., one or more of CD10, CD19, CD20, CD22, CD34, CD123, FLT-3, ROR1, CD79b, CD179b, or CD79a); or an inhibitory nucleic acid (e.g., a double stranded RNA (dsRNA), small interfering RNA (siRNA), or short hairpin RNA (shRNA)). In some embodiments, the B-cell inhibitor is a cell that expresses a CAR (e.g., a CAR-expressing immune effector cell) that binds to a B-cell antigen (e.g., CD19, CD22, CD20, CD10, CD34, CD123, FLT-3, ROR1, CD79b, CD179b, or CD79a).

In some embodiments, the B-cell inhibitor is administered prior to the cell, e.g., a population of immune effector cells, including a CD20 CAR molecule.

In some embodiments, the B-cell inhibitor is administered concurrent with the cell, e.g., a population of immune effector cells, including a CD20 CAR molecule.

In some embodiments, the B-cell inhibitor is administered after the cell, e.g., a population of immune effector cells, including a CD20 CAR molecule.

In some embodiments, the CD20 CAR-expressing cell is administered with a second CD20 inhibitor. The second CD20 inhibitor can be, e.g., a small molecule, antibody, or fragment thereof (e.g., a monospecific or bispecific antibody or fragment thereof); a recombinant protein, e.g., fusion protein, that binds to CD20; inhibitory nucleic acid; or a cell expressing a CD20 CAR, e.g., a CD20 CAR-expressing T cell or NK cell. In one embodiment, the second CD20 inhibitor is a second anti-CD20 CAR expressing cell, e.g., CD20 CART or CD20 CAR-expressing NK cell. Exemplary CD20 inhibitors are described in more detail below.

In an embodiment, the present disclosure provides a population of CAR-expressing cells, e.g., CART cells or CAR-expressing NK cells, comprising a mixture of cells expressing more than one CD20 CAR. For example, in one embodiment, the population of CAR-expressing cells includes a first cell expressing a first CD20 CAR and a second cell expressing a different, second CD20 CAR.

In certain embodiments, the CD20 CAR-expressing cell is administered with a CD22 inhibitor. The CD22 inhibitor can be, e.g., a small molecule, antibody, or fragment thereof (e.g., a monospecific or bispecific antibody or fragment thereof); a recombinant protein, e.g., fusion protein, that binds to CD22; inhibitory nucleic acid; or a cell expressing a CD22 CAR, e.g., a CD22 CAR-expressing T cell or NK cell. In one embodiment, the CD22 inhibitor is an anti-CD22 CAR expressing cell, e.g., CD22 CART or CD22 CAR-expressing NK cell. Exemplary CD22 inhibitors are described in more detail below, e.g. in Table 6.

In an embodiment, the present disclosure provides a population of CAR-expressing cells, e.g., CART cells or CAR-expressing NK cells, comprising a mixture of cells expressing CD20 CARs and CD22 CARs. For example, in one embodiment, the population of CAR-expressing cells includes a first cell expressing a CD20 CAR and a second cell expressing a CD22 CAR.

In some embodiments, the CD20 CAR-expressing cell is administered with a CD19 inhibitor. The CD19 inhibitor can be, e.g., a small molecule, antibody, or fragment thereof (e.g., a monospecific or bispecific antibody or fragment thereof); a recombinant protein, e.g., fusion protein, that binds to CD19; inhibitory nucleic acid; or a cell expressing a CD19 CAR, e.g., a CD19 CAR-expressing T cell or NK cell. In one embodiment, the CD19 inhibitor is an anti-CD19 CAR expressing cell, e.g., CD19 CART or CD19 CAR-expressing NK cell. Exemplary CD19 inhibitors are described in more detail below, e.g. in Table 11.

In one embodiment, the present disclosure provides a population of CAR-expressing cells, e.g., CART cells or CAR-expressing NK cells, comprising a mixture of cells expressing CD20 CARs and CD19 CARs. For example, in one embodiment, the population of CAR-expressing cells can include a first cell expressing a CD20 CAR and a second cell expressing a CD19 CAR.

In certain embodiments, the CD20 CAR-expressing cell is administered with a ROR1 inhibitor. The ROR1 inhibitor can be, e.g., a small molecule, antibody, or fragment thereof (e.g., a monospecific or bispecific antibody or fragment thereof); a recombinant protein, e.g., fusion protein, that binds to ROR1; inhibitory nucleic acid; or a cell expressing a ROR1 CAR, e.g., a ROR1 CAR-expressing T cell or NK cell. In one embodiment, the ROR1 inhibitor is an anti-ROR1 expressing cell, e.g., ROR1 CART or ROR1-expressing NK cell. Exemplary ROR1 inhibitors are described in more detail below.

In one embodiment, the present disclosure provides a population of CAR-expressing cells, e.g., CART cells or CAR-expressing NK cells, comprising a mixture of cells expressing CD20 CARs and ROR1 CARs. For example, in one embodiment, the population of CAR-expressing cells can include a first cell expressing a CD20 CAR and a second cell expressing a ROR1 CAR.

In some embodiments, the CD20 CAR-expressing cell is administered with a CD123 inhibitor. The CD123 inhibitor can be, e.g., a small molecule, antibody, or fragment thereof (e.g., a monospecific or bispecific antibody or fragment thereof); a recombinant protein, e.g., fusion protein, that binds to CD123; inhibitory nucleic acid; or a cell expressing a CD123 CAR, e.g., a CD123 CAR-expressing T cell or NK cell. In one embodiment, the CD123 inhibitor is an anti-CD123 CAR expressing cell, e.g., CD123 CART or CD123 CAR-expressing NK cell. Exemplary CD123 inhibitors are described in more detail below.

In one embodiment, the present disclosure provides a population of CAR-expressing cells, e.g., CART cells or CAR-expressing NK cells, comprising a mixture of cells expressing CD20 CARs and CD123 CARs. For example, in one embodiment, the population of CAR-expressing cells can include a first cell expressing a CD20 CAR and a second cell expressing a CD123 CAR.

In certain embodiment, the CD20 CAR-expressing cell is administered with a CD10 inhibitor. The CD10 inhibitor can be, e.g., a small molecule, antibody, or fragment thereof (e.g., a monospecific or bispecific antibody or fragment thereof); a recombinant protein, e.g., fusion protein, that binds to CD10; inhibitory nucleic acid; or a cell expressing a CD10 CAR, e.g., a CD10 CAR-expressing T cell or NK cell. In one embodiment, the CD10 inhibitor is an anti-CD10 CAR expressing cell, e.g., CD10 CART or CD10 CAR-expressing NK cell. Exemplary CD10 inhibitors are described in more detail below.

In one embodiment, the present disclosure provides a population of CAR-expressing cells, e.g., CART cells or CAR-expressing NK cells, comprising a mixture of cells expressing CD20 CARs and CD10 CARs. For example, in one embodiment, the population of CAR-expressing cells can include a first cell expressing a CD20 CAR and a second cell expressing a CD10 CAR.

In certain embodiments, the CD20 CAR-expressing cell is administered with a CD34 inhibitor. The CD34 inhibitor can be, e.g., a small molecule, antibody, or fragment thereof (e.g., a monospecific or bispecific antibody or fragment thereof); a recombinant protein, e.g., fusion protein, that binds to CD34; inhibitory nucleic acid; or a cell expressing a CD34 CAR, e.g., a CD34 CAR-expressing T cell or NK cell. In one embodiment, the CD34 inhibitor is an anti-CD34 CAR-expressing cell, e.g., CD34 CART or CD34 CAR-expressing NK cell. Exemplary CD34 inhibitors are described in more detail below.

In one embodiment, the present disclosure provides a population of CAR-expressing cells, e.g., CART cells or CAR-expressing NK cells, comprising a mixture of cells expressing CD20 CARs and CD34 CARs. For example, in one embodiment, the population of CAR-expressing cells can include a first cell expressing a CD20 CAR and a second cell expressing a CD34 CAR.

In certain embodiments, the CD20 CAR-expressing cell is administered with a FLT-3 inhibitor. The FLT-3 inhibitor can be, e.g., a small molecule, antibody, or fragment thereof (e.g., a monospecific or bispecific antibody or fragment thereof); a recombinant protein, e.g., fusion protein, that binds to FLT-3; inhibitory nucleic acid; or a cell expressing a FLT-3 CAR, e.g., a FLT-3 CAR-expressing T cell or NK cell. In one embodiment, the FLT-3 inhibitor is an anti-FLT-3 CAR expressing cell, e.g., FLT-3 CART or FLT-3 CAR-expressing NK cell. Exemplary FLT-3 inhibitors are described in more detail below.

In one embodiment, the present disclosure provides a population of CAR-expressing cells, e.g., CART cells or CAR-expressing NK cells, comprising a mixture of cells expressing CD20 CARs and FLT-3 CARs. For example, in one embodiment, the population of CAR-expressing cells can include a first cell expressing a CD20 CAR and a second cell expressing a FLT-3 CAR.

In certain embodiments, the CD20 CAR-expressing cell is administered with a CD79b inhibitor. The CD79b inhibitor can be, e.g., a small molecule, antibody, or fragment thereof (e.g., a monospecific or bispecific antibody or fragment thereof); a recombinant protein, e.g., fusion protein, that binds to CD79b; inhibitory nucleic acid; or a cell expressing a CD79b CAR, e.g., a CD79b CAR-expressing T cell or NK cell. In one embodiment, the CD79b inhibitor is an anti-CD79b CAR expressing cell, e.g., CD79b CART or CD79b CAR-expressing NK cell. Exemplary CD79b inhibitors are described in more detail below.

In an embodiment, the present disclosure provides a population of CAR-expressing cells, e.g., CART cells or CAR-expressing NK cells, comprising a mixture of cells expressing CD20 CARs and CD79b CARs. For example, in one embodiment, the population of CAR-expressing cells includes a first cell expressing a CD20 CAR and a second cell expressing a CD79b CAR.

In certain embodiments, the CD20 CAR-expressing cell is administered with a CD179b inhibitor. The CD179b inhibitor can be, e.g., a small molecule, antibody, or fragment thereof (e.g., a monospecific or bispecific antibody or fragment thereof); a recombinant protein, e.g., fusion protein, that binds to CD179b; inhibitory nucleic acid; or a cell expressing a CD179b CAR, e.g., a CD179b CAR-expressing T cell or NK cell. In one embodiment, the CD79b inhibitor is an anti-CD179b CAR expressing cell, e.g., CD179b CART or CD179b CAR-expressing NK cell. Exemplary CD179b inhibitors are described in more detail below.

In an embodiment, the present disclosure provides a population of CAR-expressing cells, e.g., CART cells or CAR-expressing NK cells, comprising a mixture of cells expressing CD20 CARs and CD179b CARs. For example, in one embodiment, the population of CAR-expressing cells includes a first cell expressing a CD20 CAR and a second cell expressing a CD179b CAR.

In certain embodiments, the CD20 CAR-expressing cell is administered with a CD79a inhibitor. The CD79a inhibitor can be, e.g., a small molecule, antibody, or fragment thereof (e.g., a monospecific or bispecific antibody or fragment thereof); a recombinant protein, e.g., fusion protein, that binds to CD79a; inhibitory nucleic acid; or a cell expressing a CD79a CAR, e.g., a CD79a CAR-expressing T cell or NK cell. In one embodiment, the CD79a inhibitor is an anti-CD79a CAR expressing cell, e.g., CD79a CART or CD79a CAR-expressing NK cell. Exemplary CD79a inhibitors are described in more detail below.

In an embodiment, the present disclosure provides a population of CAR-expressing cells, e.g., CART cells or CAR-expressing NK cells, comprising a mixture of cells expressing CD20 CARs and CD79a CARs. For example, in one embodiment, the population of CAR-expressing cells includes a first cell expressing a CD20 CAR and a second cell expressing a CD79a CAR.

In one aspect, the CAR (e.g., a CD19 CAR, a ROR1 CAR, a CD20 CAR, a CD22 CAR, a CD123 CAR, a CD10 CAR, a CD34 CAR, a FLT-3 CAR, a CD79b CAR, a CD179b CAR, or a CD79a CAR) comprises an optional leader sequence (e.g., an optional leader sequence described herein), an extracellular antigen binding domain, a hinge (e.g., hinge described herein), a transmembrane domain (e.g., transmembrane domain described herein), and an intracellular stimulatory domain (e.g., intracellular stimulatory domain described herein). In one aspect an exemplary CAR construct comprises an optional leader sequence (e.g., a leader sequence described herein), an extracellular antigen binding domain, a hinge, a transmembrane domain, an intracellular costimulatory domain (e.g., an intracellular costimulatory domain described herein) and an intracellular stimulatory domain.

In embodiments, provided herein is a method of treating a patient who is a non-responder, partial responder, or relapser to a CD19 inhibitor, e.g., a CD19 CAR therapy, comprising administering to the patient an inhibitor of CD20.

In some embodiments, provided herein is an inhibitor of CD20 for use in a method of treating a patient who is a non-responder, partial responder, or relapser to a CD19 inhibitor, e.g., a CD19 CAR therapy, that includes administering to the patient the inhibitor of CD20.

In embodiments, the patient comprises a CD19-negative cancer cell, and a cancer cell that is positive for CD20. In embodiments, the method further comprises a step of determining whether the patient comprises a CD19-negative cancer cell. In some embodiments, the method further comprises a step of determining whether the patient comprises a cancer cell that is positive for CD20.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting. Headings, sub-headings or numbered or lettered elements, e.g., (a), (b), (i) etc, are presented merely for ease of reading. The use of headings or numbered or lettered elements in this document does not require the steps or elements be performed in alphabetical order or that the steps or elements are necessarily discrete from one another. Other features, objects, and advantages of the invention will be apparent from the description and drawings, and from the claims.

BRIEF DESCRIPTION OF THE DRAWINGS

The following detailed description of preferred embodiments of the invention will be better understood when read in conjunction with the appended drawings. For the purpose of illustrating the invention, there are shown in the drawings embodiments which are presently preferred. It should be understood, however, that the invention is not limited to the precise arrangements and instrumentalities of the embodiments shown in the drawings.

(FIG. 7A) Number of CD3+ cells/3000 beads and (FIG. 7B) number of CD3+ CAR+ cells/3000 beads.

DESCRIPTION

Definitions

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

As used herein, the term "pharmaceutically acceptable salt" refers to those salts which are, within the scope of sound medical judgment, suitable for use in contact with the tissues of subjects without undue toxicity, irritation, allergic response and the like, and are commensurate with a reasonable benefit/risk ratio. Pharmaceutically acceptable salts are well known in the art. For example, Berge et al. describes pharmaceutically acceptable salts in detail in *J. Pharmaceutical Sciences* (1977) 66:1-19.

The term "inhibition" or "inhibitor" includes a reduction in a certain parameter, e.g., an activity, of a given molecule, e.g., CD20, CD10, CD19, CD22, CD34, CD123, FLT-3, ROR1, CD79b, CD179b, or CD79a. For example, inhibition of an activity, e.g., an activity of CD20, CD10, CD19, CD22, CD34, CD123, FLT-3, ROR1, CD79b, CD179b, or CD79a, of at least 5%, 10%, 20%, 30%, 40%, or more is included by this term. Thus, inhibition need not be 100%. Activities for the inhibitors can be determined as described herein or by assays known in the art.

Figure 10A:
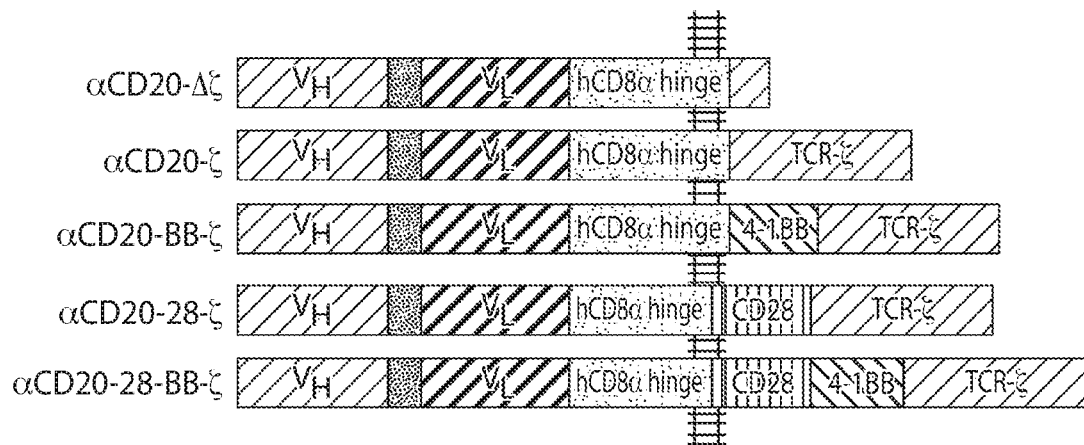
FIGS. 10A-10B are schematics showing representative CARs.
Figure 10B:
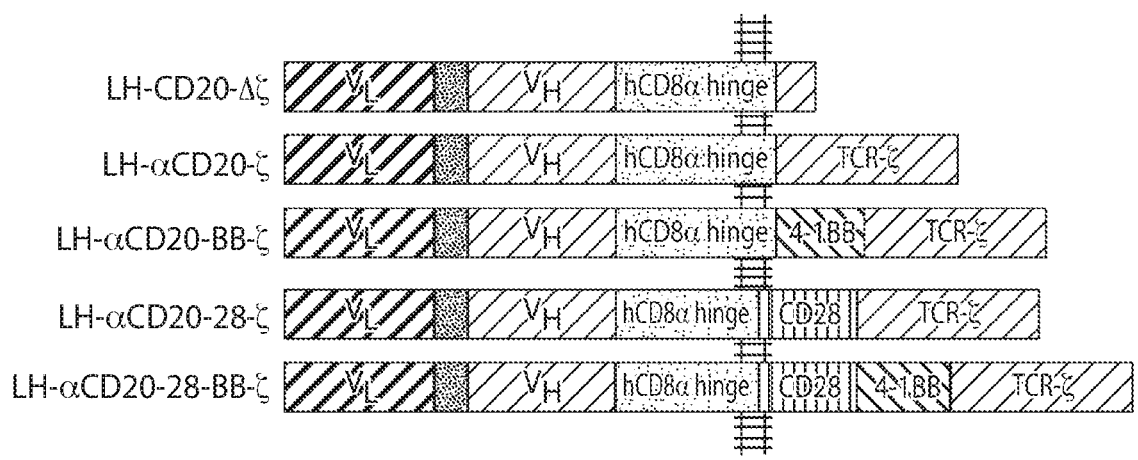

The term "Chimeric Antigen Receptor" or alternatively a "CAR" refers to a set of polypeptides, typically two in the simplest embodiments, which when in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined below. In some aspects, the set of polypeptides are contiguous with each other, e.g., are in the same polypeptide chain, e.g., comprise a chimeric fusion protein. In some embodiments, the set of polypeptides are not contiguous with each other, e.g., are in different polypeptide chains. In some embodiments, the set of polypeptides include a dimerization switch that, upon the presence of a dimerization molecule, can couple the polypeptides to one another, e.g., can couple an antigen binding domain to an intracellular signaling domain. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one aspect, the costimulatory molecule is chosen from the costimulatory molecules described herein, e.g., 4-1BB (i.e., CD137), CD27 and/or CD28 (FIG. 10A and Table 14). In one aspect, the CAR comprises a chimeric fusion protein comprising an extracellular antigen binding domain, a transmembrane domain and an intracellular signaling domain comprising a functional signaling domain derived from a stimulatory molecule. In one aspect, the CAR comprises a chimeric fusion protein comprising an extracellular antigen binding domain, a transmembrane domain and an intracellular signaling domain comprising a functional signaling domain derived from a costimulatory molecule and a functional signaling domain derived from a stimulatory molecule. In one aspect, the CAR comprises a chimeric fusion protein comprising an extracellular antigen binding domain, a transmembrane domain and an intracellular signaling domain comprising two functional signaling domains derived from one or more costimulatory molecule(s) and a functional signaling domain derived from a stimulatory molecule. In one aspect, the CAR comprises a chimeric fusion protein comprising an extracellular antigen binding domain, a transmembrane domain and an intracellular signaling domain comprising at least two functional signaling domains derived from one or more costimulatory molecule(s) and a functional signaling domain derived from a stimulatory molecule. In one aspect the CAR comprises an optional leader sequence at the amino-terminus (N-ter) of the CAR fusion protein (FIG. 10B and Table 14). In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane.

The term "signaling domain" refers to the functional portion of a protein which acts by transmitting information within the cell to regulate cellular activity via defined signaling pathways by generating second messengers or functioning as effectors by responding to such messengers.

As used herein, the term "CD20" refers to an antigenic determinant known to be detectable on B cells. Human CD20 is also called membrane-spanning 4-domains, subfamily A, member 1 (MS4A1). The human and murine amino acid and nucleic acid sequences can be found in a public database, such as GenBank, UniProt and Swiss-Prot.

For example, the amino acid sequence of human CD20 can be found at Accession Nos. NP_690605.1 and NP_068769.2, and the nucleic acid sequence encoding transcript variants 1 and 3 of the human CD20 can be found at Accession No. NM_152866.2 and NM_021950.3, respectively. In one aspect, the antigen-binding portion of the CAR recognizes and binds an antigen within the extracellular domain of the CD20 protein. In one aspect, the CD20 protein is expressed on a cancer cell. As used herein, "CD20" includes proteins comprising mutations, e.g., point mutations, fragments, insertions, deletions and splice variants of full length wild-type CD20.

As used herein, the term "ROR1" refers to an antigenic determinant known to be detectable on leukemia precursor cells. The human and murine amino acid and nucleic acid sequences can be found in a public database, such as GenBank, UniProt and Swiss-Prot. For example, the amino acid sequences of isoforms 1 and 2 precursors of human ROR1 can be found at Accession Nos. NP_005003.2 and NP_001077061.1, respectively, and the mRNA sequences encoding them can be found at Accession Nos. NM_005012.3 and NM_001083592.1, respectively. In one aspect, the antigen-binding portion of the CAR recognizes and binds an antigen within the extracellular domain of the ROR1 protein. In one aspect, the ROR1 protein is expressed on a cancer cell. As used herein, "ROR1" includes proteins comprising mutations, e.g., point mutations, fragments, insertions, deletions and splice variants of full length wild-type ROR1.

As used herein, the term "CD19" refers to the Cluster of Differentiation 19 protein, which is an antigenic determinant detectable on leukemia precursor cells. The human and murine amino acid and nucleic acid sequences can be found in a public database, such as GenBank, UniProt and Swiss-Prot. For example, the amino acid sequence of human CD19 can be found as UniProt/Swiss-Prot Accession No. P15391 and the nucleic acid sequence encoding of the human CD19 can be found at Accession No. NM_001178098. CD19 is expressed on most B lineage cancers, including, e.g., acute lymphoblastic leukaemia, chronic lymphocyte leukaemia and non-Hodgkin lymphoma. Other cells that express CD19 are provided below in the definition of "disease associated with expression of CD19." It is also an early marker of B cell progenitors. See, e.g., Nicholson et al. Mol. Immun. 34 (16-17): 1157-1165 (1997). In one aspect the antigen-binding portion of the CART recognizes and binds an antigen within the extracellular domain of the CD19 protein. In one aspect, the CD19 protein is expressed on a cancer cell. As used herein, "CD19" includes proteins comprising mutations, e.g., point mutations, fragments, insertions, deletions and splice variants of full length wild-type CD19.

As used herein, the terms "CD22," refers to an antigenic determinant known to be detectable on leukemia precursor cells. The human and murine amino acid and nucleic acid sequences can be found in a public database, such as GenBank, UniProt and Swiss-Prot. For example, the amino acid sequences of isoforms 1-5 human CD22 can be found at Accession Nos. NP 001762.2, NP 001172028.1, NP 001172029.1, NP 001172030.1, and NP 001265346.1, respectively, and the nucleic acid sequence encoding variants 1-5 of the human CD22 can be found at Accession No. NM 001771.3, NM 001185099.1, NM 001185100.1, NM 001185101.1, and NM 001278417.1, respectively. In one aspect, the antigen-binding portion of the CAR recognizes and binds an antigen within the extracellular domain of the CD22 protein. In one aspect, the CD22 protein is expressed on a cancer cell. As used herein, "CD22" includes proteins comprising mutations, e.g., point mutations, fragments, insertions, deletions and splice variants of full length wild-type CD22.

As used herein, the term "CD123" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD123 can be found at Accession Nos. NP_002174.1 (isoform 1 precursor); NP_001254642.1 (isoform 2 precursor), and the mRNA sequences encoding them can be found at Accession Nos. NM_002183.3 (variant 1); NM_001267713.1 (variant 2). In one aspect, the antigen-binding portion of the CAR recognizes and binds an antigen within the extracellular domain of the CD123 protein. In one aspect, the CD123 protein is expressed on a cancer cell. As used herein, "CD123" includes proteins comprising mutations, e.g., point mutations, fragments, insertions, deletions and splice variants of full length wild-type CD123.

As used herein, the term "CD10" refers to an antigenic determinant known to be detectable on leukemia cells. The human and murine amino acid and nucleic acid sequences can be found in a public database, such as GenBank, UniProt and Swiss-Prot. For example, the amino acid sequences of human CD10 can be found at Accession Nos. NP_009218.2; NP_000893.2; NP_009219.2; NP_009220.2, and the mRNA sequences encoding them can be found at Accession Nos. NM_007287.2 (variant ibis); NM_000902.3 (variant 1); NM_007288.2 (variant 2a); NM_007289.2 (variant 2b). In one aspect the antigen-binding portion of the CAR recognizes and binds an antigen within the extracellular domain of the CD10 protein. In one aspect, the CD10 protein is expressed on a cancer cell. As used herein, "CD10" includes proteins comprising mutations, e.g., point mutations, fragments, insertions, deletions and splice variants of full length wild-type CD10.

As used herein, the term "CD34" refers to an antigenic determinant known to be detectable on hematopoietic stem cells and some cancer cells. The human and murine amino acid and nucleic acid sequences can be found in a public database, such as GenBank, UniProt and Swiss-Prot. For example, the amino acid sequences of human CD34 can be found at Accession Nos. NP_001020280.1 (isoform a precursor); NP_001764.1 (isoform b precursor), and the mRNA sequences encoding them can be found at Accession Nos. NM_001025109.1 (variant 1); NM_001773.2 (variant 2). In one aspect the antigen-binding portion of the CAR recognizes and binds an antigen within the extracellular domain of the CD34 protein. In one aspect, the CD34 protein is expressed on a cancer cell. As used herein, "CD34" includes proteins comprising mutations, e.g., point mutations, fragments, insertions, deletions and splice variants of full length wild-type CD34.

As used herein, the term "FLT-3" refers to an antigenic determinant known to be detectable on hematopoietic progenitor cells and some cancer cells, e.g., leukemia cells. The human and murine amino acid and nucleic acid sequences can be found in a public database, such as GenBank, UniProt and Swiss-Prot. For example, the amino acid sequences of human FLT-3 can be found at Accession Nos. NP_004110.2, and the mRNA sequences encoding them can be found at Accession Nos. NM_004119.2. In one aspect, the antigen-binding portion of the CAR recognizes and binds an antigen within the extracellular domain of the FLT-3 protein. In one aspect, the FLT-3 protein is expressed on a cancer cell. As used herein, "FLT-3" includes proteins comprising mutations, e.g., point mutations, fragments, insertions, deletions and splice variants of full length wild-type FLT-3.

As used herein, the term "CD79b" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD79b can be found at Accession Nos. NP_000617.1 (isoform 1 precursor), NP_067613.1 (isoform 2 precursor), or NP_001035022.1 (isoform 3 precursor), and the mRNA sequences encoding them can be found at Accession Nos. NM_000626.2 (transcript variant 1), NM_021602.2 (transcript variant 2), or NM_001039933.1 (transcript variant 3). In one aspect, the antigen-binding portion of the CAR recognizes and binds an antigen within the extracellular domain of the CD79b protein. In one aspect, the CD79b protein is expressed on a cancer cell. As used herein, "CD79b" includes proteins comprising mutations, e.g., point mutations, fragments, insertions, deletions and splice variants of full length wild-type CD79b.

As used herein, the term "CD79a" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD79a can be found at Accession Nos. NP_001774.1 (isoform 1 precursor) or NP_067612.1 (isoform 2 precursor), and the mRNA sequences encoding them can be found at Accession Nos. NM_001783.3 (transcript variant 1) or NM_021601.3 (transcript variant 2). In one aspect, the antigen-binding portion of the CAR recognizes and binds an antigen within the extracellular domain of the CD79a protein. In one aspect, the CD79a protein is expressed on a cancer cell. As used herein, "CD79a" includes proteins comprising mutations, e.g., point mutations, fragments, insertions, deletions and splice variants of full length wild-type CD79a.

As used herein, the term "CD179b" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD179b can be found at Accession Nos. NP_064455.1 (isoform a precursor) or NP_690594.1 (isoform b precursor), and the mRNA sequences encoding them can be found at Accession Nos. NM_020070.3 (transcript variant 1) or NM_152855.2 (transcript variant 2). In one aspect, the antigen-binding portion of the CAR recognizes and binds an antigen within the extracellular domain of the CD179b protein. In one aspect, the CD179b protein is expressed on a cancer cell. As used herein, "CD179b" includes proteins comprising mutations, e.g., point mutations, fragments, insertions, deletions and splice variants of full length wild-type CD179b.

As used herein, the term "binding domain" (e.g., "CD20 binding domain") refers to a protein, e.g., an immunoglobulin chain or fragment thereof, comprising at least one immunoglobulin variable domain sequence. The term "binding domain" (also referred to herein as "antibody molecule") encompasses antibodies and antibody fragments. In an embodiment an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The term "antibody fragment" refers to at least one portion of an antibody, that retains the ability to specifically interact with (e.g., by binding, steric hinderance, stabilizing/destabilizing, spatial distribution) an epitope of an antigen. Examples of antibody fragments include, but are not limited to, Fab, Fab', F(ab')$_2$, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multi-specific antibodies formed from antibody fragments such as a bivalent fragment comprising two Fab fragments linked by a disulfide brudge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide minibodies). The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The term "complementarity determining region" or "CDR," as used herein, refers to the sequences of amino acids within antibody variable regions which confer antigen specificity and binding affinity. The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273, 927-948 ("Chothia" numbering scheme) and ImMunoGenTics (IMGT) numbering (Lefranc, M.-P., The Immunologist, 7, 132-136 (1999); Lefranc, M.-P. et al., Dev. Comp. Immunol., 27, 55-77 (2003) ("IMGT" numbering scheme). For example, for classic formats, under Kabat, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under Chothia, the CDR amino acids in the VH are numbered 26-32 (HCDR1), 52-56 (HCDR2), and 95-102

(HCDR3); and the amino acid residues in VL are numbered 26-32 (LCDR1), 50-52 (LCDR2), and 91-96 (LCDR3). By combining the CDR definitions of both Kabat and Chothia, the CDRs consist of amino acid residues 26-35 (HCDR1), 50-65 (HCDR2), and 95-102 (HCDR3) in human VH and amino acid residues 24-34 (LCDR1), 50-56 (LCDR2), and 89-97 (LCDR3) in human VL. Under IMGT, the CDR amino acid residues in the VH are numbered approximately 26-35 (CDR1), 51-57 (CDR2) and 93-102 (CDR3), and the CDR amino acid residues in the VL are numbered approximately 27-32 (CDR1), 50-52 (CDR2), and 89-97 (CDR3) (numbering according to "IMGT"). Under IMGT, the CDR regions of an antibody can be determined using the program IMGT/DomainGap Align.

The portion of the CAR of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody, or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleic acid sequence or a partial nucleic acid sequence encoding a protein that elicits an immune response therefore encodes an "antigen" as that term is used herein. Furthermore, one skilled in the art will understand that an antigen need not be encoded solely by a full length nucleic acid sequence of a gene. It is readily apparent that the present invention includes, but is not limited to, the use of partial nucleic acid sequences of more than one gene and that these nucleic acid sequences are arranged in various combinations to encode polypeptides that elicit the desired immune response. Moreover, a skilled artisan will understand that an antigen need not be encoded by a "gene" at all. It is readily apparent that an antigen can be generated, synthesized, or can be derived from a biological sample, or might be macromolecule besides a polypeptide. Such a biological sample can include, but is not limited to a tissue sample, a tumor sample, a cell or a fluid with other biological components.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies of the invention in prevention of the occurrence of cancer in the first place. The term "anti-tumor effect" refers to a biological effect which can be manifested by various means, including but not limited to, e.g., a decrease in tumor volume, a decrease in the number of tumor cells, a decrease in tumor cell proliferation, or a decrease in tumor cell survival. The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "xenogeneic" refers to a graft derived from an animal of a different species.

The term "combination" refers to either a fixed combination in one dosage unit form, or a combined administration where a compound of the present invention and a combination partner (e.g. another drug as explained below, also referred to as "therapeutic agent" or "co-agent") may be administered independently at the same time or separately within time intervals, especially where these time intervals allow that the combination partners show a cooperative, e.g. synergistic effect. The single components may be packaged in a kit or separately. One or both of the components (e.g., powders or liquids) may be reconstituted or diluted to a desired dose prior to administration. The terms "co-administration" or "combined administration" or the like as utilized herein are meant to encompass administration of the selected combination partner to a single subject in need thereof (e.g. a patient), and are intended to include treatment regimens in which the agents are not necessarily administered by the same route of administration or at the same time. The term "pharmaceutical combination" as used herein means a product that results from the mixing or combining of more than one therapeutic agent and includes both fixed and non-fixed combinations of the therapeutic agents. The term "fixed combination" means that the therapeutic agents, e.g. a compound of the present invention and a combination partner, are both administered to a patient simultaneously in the form of a single entity or dosage. The term "non-fixed combination" means that the therapeutic agents, e.g. a compound of the present invention and a combination partner, are both administered to a patient as separate entities either simultaneously, concurrently or sequentially with no specific time limits, wherein such administration provides therapeutically effective levels of the two compounds in the body of the patient. The latter also applies to cocktail therapy, e.g. the administration of three or more therapeutic agent.

The term "cancer" refers to a disease characterized by the rapid and uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid tumors. As used herein, the term "cancer" or "tumor" includes premalignant, as well as malignant cancers and tumors.

The phrase "disease associated with expression of CD20" as used herein includes but is not limited to, a disease associated with expression of CD20 (e.g., wild-type or mutant CD20) or condition associated with cells that express, or at any time expressed, CD20 (e.g., wild-type or mutant CD20) including, e.g., a proliferative disease such as a cancer or malignancy or a precancerous condition such as a myelodysplasia, a myelodysplastic syndrome or a preleukemia; or a noncancer related indication associated with cells which express CD20 (e.g., wild-type or mutant CD20). For the avoidance of doubt, a disease associated with expression of CD20 may include a condition associated with cells that do not presently express CD20, e.g., because CD20 expression has been downregulated, e.g., due to treatment with a molecule targeting CD20, e.g., a CD20 inhibitor described herein, but which at one time expressed CD20. In one aspect, a cancer associated with expression of CD20 is a hematological cancer. In one aspect, a hematological cancer includes but is not limited to AML, myelodysplastic syndrome, ALL, hairy cell leukemia, Prolymphocytic leukemia, Chronic myeloid leukemia, Hodgkin lymphoma, Blastic plasmacytoid dendritic cell neoplasm, and the like. Further, diseases associated with expression of CD20 expression include, but are not limited to, e.g., atypical and/or non-classical cancers, malignancies, precancerous conditions or proliferative diseases associated with expression of CD20. Non-cancer related indications associated with expression of CD20 may also be included.

The phrase "disease associated with expression of CD19" includes, but is not limited to, a disease associated with expression of CD19 (e.g., wild-type or mutant CD19) or condition associated with cells that express, or at any time expressed, CD19 (e.g., wild-type or mutant CD19) including, e.g., proliferative diseases such as a cancer or malignancy or a precancerous condition such as a myelodysplasia, a myelodysplastic syndrome or a preleukemia; or a noncancer related indication associated with cells which express CD19. For the avoidance of doubt, a disease associated with expression of CD19 may include a condition associated with cells that do not presently express CD19, e.g., because CD19 expression has been downregulated, e.g., due to treatment with a molecule targeting CD19, e.g., a CD19 CAR, but which at one time expressed CD19. In one aspect, a cancer associated with expression of CD19 is a hematological cancer. In one aspect, the hematological cancer is a leukemia or a lymphoma. In one aspect, a cancer associated with expression of CD19 includes cancers and malignancies including, but not limited to, e.g., one or more acute leukemias including but not limited to, e.g., B-cell acute Lymphoid Leukemia (BALL), T-cell acute Lymphoid Leukemia (TALL), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of CD19 comprise, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma (MCL), Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further, diseases associated with expression of CD19 expression include, but not limited to, e.g., atypical and/or non-classical cancers, malignancies, precancerous conditions or proliferative diseases associated with expression of CD19. Non-cancer related indications associated with expression of CD19 include, but are not limited to, e.g., autoimmune disease, (e.g., lupus), inflammatory disorders (allergy and asthma) and transplantation. In some embodiments, the CD19-expressing cells express, or at any time expressed, CD19 mRNA. In an embodiment, the CD19-expressing cells produce a CD19 protein (e.g., wild-type or mutant), and the CD19 protein may be present at normal levels or reduced levels. In an embodiment, the CD19-expressing cells produced detectable levels of a CD19 protein at one point, and subsequently produced substantially no detectable CD19 protein.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the invention can be replaced with other amino acid residues from the same side chain family and the altered CAR can be tested using the functional assays described herein.

The term "stimulation," refers to a primary response induced by binding of a stimulatory molecule (e.g., a TCR/CD3 complex or CAR) with its cognate ligand (or tumor antigen in the case of a CAR) thereby mediating a signal transduction event, such as, but not limited to, signal transduction via the TCR/CD3 complex or signal transduction via the appropriate NK receptor or signaling domains of the CAR. Stimulation can mediate altered expression of certain molecules.

The term "stimulatory molecule," refers to a molecule expressed by an immune cell, e.g., T cell, NK cell, or B cell, that provides the cytoplasmic signaling sequence(s) that regulates activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use in the invention includes, but is not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO: 805, or the equivalent residues from a non-human species, e.g., mouse, rodent, monkey, ape and the like. In a specific CAR of the invention, the primary signaling sequence of CD3-zeta is the sequence as provided in SEQ ID NO: 807, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NK-T) cells, mast cells, and myeloid-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

An "intracellular signaling domain," as the term is used herein, refers to an intracellular portion of a molecule. The intracellular signaling domain generates a signal that promotes an immune effector function of the CAR containing cell, e.g., a CART cell or CAR-expressing NK cell. Examples of immune effector function, e.g., in a CART cell or CAR-expressing NK cell, include cytolytic activity and helper activity, including the secretion of cytokines.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10 and DAP12.

The term "zeta" or alternatively "zeta chain", "CD3-zeta" or "TCR-zeta" is defined as the protein provided as GenBan Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain or functional derivative thereof, that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO: 805. In one aspect, the "zeta stimulatory domain" or a "CD3-zeta stimulatory domain" is the sequence provided as SEQ ID NO: 807.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that contribute to an efficient immune response. Costimulatory molecules include, but are not limited to an MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1(CD11a/CD18), 4-1BB (CD137), B7-H3, CDS, ICAM-1, ICOS 5 (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CSD, CD7, CD287, LIGHT, NKG2C, NKG2D, SLAMF7, NKp80, NKp30, NKp44, NKp46, CD160, B7-H3, and a ligand that specifically binds with CD83, and the like.

The intracellular signaling domain can comprise the entire intracellular portion, or the entire native intracellular signaling domain, of the molecule from which it is derived, or a functional fragment or derivative thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank accno. AAA62478.2, or the equivalent residues from a non-human species, e.g., mouse, rodent, monkey, ape and the like. In one aspect, the "4-1BB costimulatory domain" is the sequence provided as SEQ ID NO: 803 or the equivalent residues from a non-human species, e.g., mouse, rodent, monkey, ape and the like.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleic acid sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleic acid sequence encoding an amino acid sequence" includes all nucleic acid sequences that are degenerate versions of each other and that encode the same amino acid sequence. The phrase nucleic acid sequence that encodes a protein or a RNA may also include introns to the extent that the nucleic acid sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleic acid sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleic acid sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies), which contain minimal sequence derived from non-human immunoglobulin. For the most part, humanized antibodies and antibody fragments thereof are human immunoglobulins (recipient antibody or antibody fragment) in which residues from a complementarity-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues that are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

"Murine" refers to mice or rats. For example, a murine antibody or fragment thereof contains the sequence of an antibody or fragment thereof that is isolated from a murine animal, e.g., mouse or rat.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementarity sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence that is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one that expresses the gene product in a tissue specific manner.

The term "constitutive" promoter refers to a nucleic acid sequence that, when operably linked with a polynucleotide that encodes or specifies a gene product, causes the gene product to be produced in a cell under most or all physiological conditions of the cell.

The term "inducible" promoter refers to a nucleic acid sequence that, when operably linked with a polynucleotide that encodes or specifies a gene product, causes the gene product to be produced in a cell substantially only when an inducer that corresponds to the promoter is present in the cell.

The term "tissue-specific" promoter refers to a nucleic acid sequence that, when operably linked with a polynucleotide that encodes or specifies a gene product, causes the gene product to be produced in a cell substantially only if the cell is a cell of the tissue type corresponding to the promoter.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser) (SEQ ID NO: 834), repeated n times where n is a positive integer equal to or greater than 1. For example, n=1, n=2, n=3. n=4, n=5 and n=6, n=7, n=8, n=9 and n=10. In one embodiment, the flexible polypeptide linkers include, but are not limited to, (Gly4 Ser)$_4$ (SEQ ID NO: 23) or (Gly4 Ser)$_3$ (SEQ ID NO: 541). In another embodiment, the linkers include multiple repeats of (Gly2Ser), and (GlySer). In another embodiment, the polypeptide does not include a linker, e.g., (n=0). Also included within the scope of the invention are linkers described in WO2012/138475, incorporated herein by reference).

As used herein, a 5' cap (also termed an RNA cap, an RNA 7-methylguanosine cap or an RNA m$^7$G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 1092), preferably greater than 64, more preferably greater than 100, most preferably greater than 300 or 400. poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

As used herein, the terms "treat", "treatment" and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In some embodiments, the terms "treat", "treatment" and "treating"-refer to the inhibition of the progression of a proliferative disorder, either physically by, e.g., stabilization of a discernible symptom, physiologically by, e.g., stabilization of a physical parameter, or both. In some embodiments, the terms "treat", "treatment" and "treating" refer to the reduction or stabilization of tumor size or cancerous cell count.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals, human).

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

The term "therapeutic" as used herein means a treatment. A therapeutic effect is obtained by reduction, suppression, remission, or eradication of a disease state.

The term "prophylaxis" as used herein means the prevention of or protective treatment for a disease or disease state.

In the context of the present invention, "tumor antigen" or "hyperproliferative disorder antigen" or "antigen associated with a hyperproliferative disorder" refers to antigens that are common to specific hyperproliferative disorders. In certain aspects, the hyperproliferative disorder antigens of the present invention are derived from, cancers including but not limited to primary or metastatic melanoma, thymoma, lymphoma, sarcoma, lung cancer, liver cancer, non-Hodgkin's lymphoma, non-Hodgkins lymphoma, leukemias, uterine cancer, cervical cancer, bladder cancer, kidney cancer and adenocarcinomas such as breast cancer, prostate cancer, ovarian cancer, pancreatic cancer, and the like.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to an antibody, or a ligand, which recognizes and binds with a binding partner (e.g., a stimulatory tumor antigen) protein present in a sample, but which antibody or ligand does not substantially recognize or bind other molecules in the sample.

"Refractory" as used herein refers to a disease, e.g., cancer, that does not respond to a treatment. In embodiments, a refractory cancer can be resistant to a treatment before or at the beginning of the treatment. In some embodiments, the refractory cancer can become resistant during a treatment. A refractory cancer is also called a resistant cancer.

A subject "responds" to treatment if a parameter of a cancer (e.g., a hematological cancer, e.g., cancer cell growth, proliferation and/or survival) in the subject is retarded or reduced by a detectable amount, e.g., about 5%, 10%, 20%, 30%, 40%, 50%, 60%, 70%, 80%, 90% or more as determined by any appropriate measure, e.g., by mass, cell count or volume. In one example, a subject responds to treatment if the subject experiences a life expectancy extended by about 5%, 10%, 20%, 30%, 40%, 50% or more beyond the life expectancy predicted if no treatment is administered. In another example, a subject responds to treatment, if the subject has an increased disease-free survival, overall survival or increased time to progression. Several methods can be used to determine if a patient responds to a treatment including, for example, criteria provided by NCCN Clinical Practice Guidelines in Oncology (NCCN GUIDELINES®). For example, in the context of B-ALL, a complete response or complete responder, may involve one or more of: <5% BM blast, >1000 neutrophil/ANC (/µL). >100,000 platelets (/µL) with no circulating blasts or extramedullary disease (no lymphadenopathy, splenomegaly, skin/gum infiltration/testicular mass/CNS involvement), Trilineage hematopoiesis, and no recurrence for 4 weeks. A partial responder may involve one or more of >50% reduction in BM blast, >1000 neutrophil/ANC (/µL). >100,000 platelets (/µL). A non-responder can show disease progression, e.g., >25% in BM blasts. In an embodiment, a complete responder is defined as having 7% or greater CD27+ CD45RO− cells in the CD8+ population. In an embodiment, the percent of CAR+ cells at pre-harvest levels distinguish responders (e.g., complete responders and partial responders) from non-responders (NR).

The term "relapse" as used herein refers to reappearance of a cancer after an initial period of responsiveness (e.g., complete response or partial response). The initial period of responsiveness may involve the level of cancer cells falling below a certain threshold, e.g., below 20%, 1%, 10%, 5%, 4%, 3%, 2%, or 1%. The reappearance may involve the level of cancer cells rising above a certain threshold, e.g., above 20%, 1%, 10%, 5%, 4%, 3%, 2%, or 1%. For example, e.g., in the context of B-ALL, the reappearance may involve, e.g., a reappearance of blasts in the blood, bone marrow (>5%), or any extramedullary site, after a complete response. A complete response, in this context, may involve <5% BM blast. More generally, in an embodiment, a response (e.g., complete response or partial response) can involve the absence of detectable MRD (minimal residual disease). In an embodiment, the initial period of responsiveness lasts at least 1, 2, 3, 4, 5, or 6 days; at least 1, 2, 3, or 4 weeks; at least 1, 2, 3, 4, 6, 8, 10, or 12 months; or at least 1, 2, 3, 4, or 5 years.

"Regulatable chimeric antigen receptor (RCAR)," as that term is used herein, refers to a set of polypeptides, typically two in the simplest embodiments, which when in a RCARX cell, provides the RCARX cell with specificity for a target cell, typically a cancer cell, and with regulatable intracellular signal generation or proliferation, which can optimize an immune effector property of the RCARX cell. An RCARX cell relies at least in part, on an antigen binding domain to provide specificity to a target cell that comprises the antigen bound by the antigen binding domain. In an embodiment, an RCAR includes a dimerization switch that, upon the presence of a dimerization molecule, can couple an intracellular signaling domain to the antigen binding domain.

"Membrane anchor" or "membrane tethering domain", as that term is used herein, refers to a polypeptide or moiety, e.g., a myristoyl group, sufficient to anchor an extracellular or intracellular domain to the plasma membrane.

"Switch domain," as that term is used herein, e.g., when referring to an RCAR, refers to an entity, typically a polypeptide-based entity, that, in the presence of a dimerization molecule, associates with another switch domain. The association results in a functional coupling of a first entity linked to, e.g., fused to, a first switch domain, and a second entity linked to, e.g., fused to, a second switch domain. A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the first and second switch domains are different from one another, e.g., they are polypeptides having different primary amino acid sequences, and are referred to collectively as a heterodimerization switch. In embodiments, the switch is intracellular. In embodiments, the switch is extracellular. In embodiments, the switch domain is a polypeptide-based entity, e.g., FKBP or FRB-based, and the dimerization molecule is small molecule, e.g., a rapalogue. In embodiments, the switch domain is a polypeptide-based entity, e.g., an scFv that binds a myc peptide, and the dimerization molecule is a polypeptide, a fragment thereof, or a multimer of a polypeptide, e.g., a myc ligand or multimers of a myc ligand that bind to one or more myc scFvs. In embodiments, the switch domain is a polypeptide-based entity, e.g., myc receptor, and the dimerization molecule is an antibody or fragments thereof, e.g., myc antibody.

"Dimerization molecule," as that term is used herein, e.g., when referring to an RCAR, refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g, RAD001.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay, or measurement of phosphorylated S6 levels by western blot. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "low, immune enhancing, dose" when used in conjunction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive T cells and/or an increase in the number of PD-1 negative T cells, or an increase in the ratio of PD-1 negative T cells/PD-1 positive T cells. In an embodiment, the low, immune enhancing, dose of mTOR inhibitor results in an increase in the number of naive T cells. In an embodiment, the low, immune enhancing, dose of mTOR inhibitor results in one or more of the following:

an increase in the expression of one or more of the following markers: $CD62L^{high}$, $CD127^{high}$, $CD27^+$, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased $CD62L^{high}$, increased $CD127^{high}$ increased CD27+, decreased KLRG1, and increased BCL2; wherein any of the changes described above occurs, e.g., at least transiently, e.g., as compared to a non-treated subject.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

DETAILED DESCRIPTION

Provided herein are compositions of matter and methods of use for the treatment or prevention of a disease such as cancer using CD20 and/or chimeric antigen receptors (CAR).

In one aspect, the invention provides a number of chimeric antigen receptors (CAR) comprising an antibody or antibody fragment engineered for specific binding to a CD20 protein, or CD22 protein or fragments thereof. In one aspect, the invention provides a cell (e.g., T cell or NK cell) engineered to express a CAR, wherein the cell (e.g., "CART") exhibits an antitumor property. In one aspect a cell is transformed with the CAR and the at least part of the CAR is expressed on the cell surface. In some embodiments, the cell (e.g., T cell or NK cell) is transduced with a viral vector encoding a CAR. In some embodiments, the viral vector is a retroviral vector. In some embodiments, the viral vector is a lentiviral vector. In some such embodiments, the cell may stably express the CAR. In another embodiment, the cell (e.g., T cell or NK cell) is transfected with a nucleic acid, e.g., mRNA, cDNA, DNA, encoding a CAR. In some such embodiments, the cell may transiently express the CAR.

In one aspect, the CD20 or CD22 binding domain, e.g., the murine, human or humanized CD20 binding domain, of the CAR is a scFv antibody fragment. In one aspect, such antibody fragments are functional in that they retain the equivalent binding affinity, e.g., they bind the same antigen with comparable efficacy, as the IgG antibody having the same heavy and light chain variable regions. In one aspect such antibody fragments are functional in that they provide a biological response that can include, but is not limited to, activation of an immune response, inhibition of signal-transduction origination from its target antigen, inhibition of kinase activity, and the like, as will be understood by a skilled artisan.

In some aspects, the antibodies of the invention are incorporated into a chimeric antigen receptor (CAR). In one aspect, the CAR comprises the polypeptide sequence provided herein as Table 1.

In one aspect, the CD20 or CD22 binding domain, e.g., murine, humanized or human CD20 or CD22 binding domain, portion of a CAR of the invention is encoded by a transgene whose sequence has been codon optimized for expression in a mammalian cell. In one aspect, entire CAR construct of the invention is encoded by a transgene whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleic acid sequences. A variety of codon optimization methods is known in the art, and include, e.g., methods disclosed in at least U.S. Pat. Nos. 5,786,464 and 6,114,148.

In one aspect, the antigen binding domain of the CAR comprises a murine (e.g., rat or mouse) antibody or antibody fragment. In one aspect, the antigen binding domain of the CAR comprises a human CD20 or CD22 antibody or antibody fragment. In one aspect, the antigen binding domain of the CAR comprises a humanized CD20 or CD22 antibody or antibody fragment. In one aspect, the antigen binding domain of the CAR comprises a murine CD20 or CD22 antibody fragment comprising an scFv. In one aspect, the antigen binding domain of the CAR comprises human CD20 or CD22 antibody fragment comprising an scFv. In one aspect, the antigen binding domain of the CAR is a human CD20 or CD22 scFv. In one aspect, the antigen binding domain of the CAR comprises a humanized CD20 antibody fragment comprising an scFv. In one aspect, the antigen binding domain of the CAR is a humanized CD20 or CD22 scFv.

In one aspect, the CAR20 binding domain comprises the scFv portion provided in SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429.

In one aspect, the CAR22 binding domain comprises the scFv protein as set forth in Table 6.

Furthermore, the present invention provides CD20 CAR of CD22 CAR compositions and their use in medicaments or methods for treating, among other diseases, cancer or any malignancy or autoimmune diseases involving cells or tissues which express CD20 or CD22.

In one aspect, the CAR of the invention can be used to eradicate CD20-expressing or CD22-expressing normal cells, thereby applicable for use as a cellular conditioning therapy prior to cell transplantation. In one aspect, the CD20-expressing or CD22-expressing normal cell is a CD20-expressing or CD22-expressing expressing myeloid progenitor cell and the cell transplantation is a stem cell transplantation.

In one aspect, the invention provides a cell (e.g., T cell or NK cell) engineered to express a chimeric antigen receptor (e.g., CART) of the present invention, wherein the cell (e.g., "CART") exhibits an antitumor property. Accordingly, the invention provides a CD20-CAR that comprises a CD20 binding domain and/or a CD22-CAR that comprises a CD22 binding domain and is engineered into a T cell or NK cell and methods of their use for adoptive therapy.

In one aspect, the CD20-CAR or CD22-CAR comprises at least one intracellular domain, e.g., described herein, e.g., selected from the group of a CD137 (4-1BB) signaling domain, a CD28 signaling domain, a CD3zeta signal domain, and any combination thereof. In one aspect, the CD20-CAR or CD22-CAR comprises at least one intracellular signaling domain is from one or more co-stimulatory molecule(s) other than a CD137 (4-1BB) or CD28.

Chimeric Antigen Receptor (CAR)

The present invention encompasses a recombinant DNA construct comprising sequences encoding a CAR, wherein the CAR comprises an antigen binding domain (e.g., antibody, antibody fragment) that binds specifically to CD20 and/or CD22 or a fragment thereof, e.g., human CD20 or CD22, wherein the sequence of the CD20 or CD22 binding domain (e.g., antibody or antibody fragment) is, e.g., contiguous with and in the same reading frame as a nucleic acid sequence encoding an intracellular signaling domain. The intracellular signaling domain can comprise a costimulatory signaling domain and/or a primary signaling domain, e.g., a zeta chain. The costimulatory signaling domain refers to a portion of the CAR comprising at least a portion of the intracellular domain of a costimulatory molecule.

In specific aspects, a CAR construct of the invention comprises a scFv domain selected from the group consisting of SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429, wherein the scFv may be preceded by an optional leader sequence such as provided in SEQ ID NO: 797, and followed by an optional hinge sequence such as provided in SEQ ID NO: 799 or SEQ ID NO: 814 or SEQ ID NO: 815, a transmembrane region such as provided in SEQ ID NO: 801, an intracellular signalling domain that includes SEQ ID NO: 803 or SEQ ID NO: 804 and a CD3 zeta sequence that includes SEQ ID NO: 805 or SEQ ID NO: 807, e.g., wherein the domains are contiguous with and in the same reading frame to form a single fusion protein. Also included in the invention is a nucleic acid sequence that encodes the polypeptide of each of the scFv fragments selected from the group consisting of SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429.

In one embodiment, the nucleic acid sequence encoding the CD20 binding domain comprises a sequence selected from a group consisting of SEQ ID NO: 25, SEQ ID NO: 52, SEQ ID NO: 79, SEQ ID NO: 106, SEQ ID NO: 133, SEQ ID NO: 160, SEQ ID NO: 187, SEQ ID NO: 214, SEQ ID NO: 241, SEQ ID NO: 268, SEQ ID NO: 295, SEQ ID NO: 322, SEQ ID NO: 349, SEQ ID NO: 376, SEQ ID NO: 403, and SEQ ID NO: 430. In an embodiment, the nucleic acid sequence encoding the CD20 binding domain comprises a sequence as set forth in Table 1.

In one embodiment, the nucleic acid sequence encoding the CD22 binding domain comprises a sequence as set forth in Table 6.

Further embodiments include a nucleic acid sequence that encodes a polypeptide of Table 1 and/or Table 6. Further embodiments include a nucleic acid sequence that encodes a polypeptide of any of Table 1 and/or Table 6 and each of the domains of SEQ ID NOs: 797, 799, 801, 803, 805, and optionally 818.

In one aspect an exemplary CD20CAR constructs comprise an optional leader sequence, an extracellular antigen binding domain, a hinge, a transmembrane domain, and an intracellular stimulatory domain. In one aspect an exemplary CD20CAR or CD22CAR construct comprises an optional leader sequence, an extracellular antigen binding domain, a hinge, a transmembrane domain, an intracellular costimulatory domain and an intracellular stimulatory domain.

In some embodiments, full-length CD20 CAR sequences are also provided herein as Table 1.

In some embodiments, full-length CD22 CAR sequences are also provided herein as Table 6.

An exemplary leader sequence is provided as SEQ ID NO: 797. An exemplary hinge/spacer sequence is provided as SEQ ID NO: 799 or SEQ ID NO: 814 or SEQ ID NO: 816. An exemplary transmembrane domain sequence is provided as SEQ ID NO: 801. An exemplary sequence of the intracellular signaling domain of the 4-1BB protein is provided as SEQ ID NO: 803. An exemplary sequence of the intracellular signaling domain of CD27 is provided as SEQ ID NO: 818. An exemplary CD3zeta domain sequence is provided as SEQ ID NO: 805 or SEQ ID NO: 807.

In one aspect, the present invention encompasses a recombinant nucleic acid construct comprising a nucleic acid molecule encoding a CAR, wherein the nucleic acid molecule comprises the nucleic acid sequence encoding a CD20 binding domain, e.g., described herein, e.g., that is contiguous with and in the same reading frame as a nucleic acid sequence encoding an intracellular signaling domain. In one aspect, a CD20 binding domain is selected from SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429. In one aspect, the present invention encompasses a recombinant nucleic acid construct comprising a nucleic acid molecule encoding a CAR, wherein the nucleic acid molecule comprises a nucleic acid sequence encoding a CD20 binding domain, e.g., wherein the sequence is contiguous with and in the same reading frame as the nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, and the like. In some instances, the CAR can comprise any combination of CD3-zeta, CD28, 4-1BB, and the like.

In one aspect, the nucleic acid sequence of a CAR construct of the invention is selected from one or more of SEQ ID NO: 25, SEQ ID NO: 52, SEQ ID NO: 79, SEQ ID NO: 106, SEQ ID NO: 133, SEQ ID NO: 160, SEQ ID NO: 187, SEQ ID NO: 214, SEQ ID NO: 241, SEQ ID NO: 268, SEQ ID NO: 295, SEQ ID NO: 322, SEQ ID NO: 349, SEQ ID NO: 376, SEQ ID NO: 403, and SEQ ID NO: 430. The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the nucleic acid of interest can be produced synthetically, rather than cloned.

The present invention includes retroviral and lentiviral vector constructs expressing a CAR that can be directly transduced into a cell.

The present invention also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO: 1093). RNA so produced can efficiently transfect different kinds of cells. In one embodiment, the template includes sequences for the CAR. In an embodiment, an RNA CAR vector is transduced into a T cell or NK cell by electroporation.

Antigen Binding Domain

In one aspect, the CAR of the invention comprises a target-specific binding element otherwise referred to as an antigen binding domain. The choice of moiety depends upon the type and number of ligands that define the surface of a target cell. For example, the antigen binding domain may be chosen to recognize a ligand that acts as a cell surface marker on target cells associated with a particular disease state.

In one aspect, the CAR-mediated T-cell response can be directed to an antigen of interest by way of engineering an antigen binding domain that specifically binds a desired antigen into the CAR.

In one aspect, the portion of the CAR comprising the antigen binding domain comprises an antigen binding domain that targets CD20 or a fragment thereof. In one aspect, the antigen binding domain targets human CD20 or a fragment thereof.

In one aspect, the portion of the CAR comprising the antigen binding domain comprises an antigen binding domain that targets CD22 or a fragment thereof. In one aspect, the antigen binding domain targets human CD22 or a fragment thereof.

The antigen binding domain can be any domain that binds to the antigen including but not limited to a monoclonal antibody, a polyclonal antibody, a recombinant antibody, a murine antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment. Thus, in one aspect, the antigen binding domain comprises a human antibody or an antibody fragment.

In other instances, the antigen binding domain is derived from a different species (e.g., murine) from that in which the CAR will ultimately be used in (e.g., human).

In one embodiment, the CD20 binding domain comprises one or more (e.g., all three) light chain complementarity determining region 1 (LCDR1), light chain complementarity determining region 2 (LCDR2), and light chain complementarity determining region 3 (LCDR3) of a CD20 binding domain described herein, and/or one or more (e.g., all three) heavy chain complementarity determining region 1 (HCDR1), heavy chain complementarity determining region 2 (HCDR2), and heavy chain complementarity determining region 3 (HCDR3) of a CD20 binding domain described herein, e.g., a CD20 binding domain comprising one or more, e.g., all three, LCDRs and one or more, e.g., all three, HCDRs. In one embodiment, the CD20 binding domain comprises one or more (e.g., all three) heavy chain complementarity determining region 1 (HCDR1), heavy chain complementarity determining region 2 (HCDR2), and heavy chain complementarity determining region 3 (HCDR3) of a CD20 binding domain described herein, e.g., the CD20 binding domain has two variable heavy chain regions, each comprising a HCDR1, a HCDR2 and a HCDR3 described herein.

In one embodiment, the LCDR1, LCDR2, and/or LCDR3 comprises (or consists of) an amino acid sequence listed in Table 3. In one embodiment, the HCDR1, HCDR2, and/or HCDR3 comprises (or consists of) an amino acid sequence listed in Table 2.

In one embodiment, the CD20 binding domain comprises a light chain variable region described herein (e.g., in Table 5) and/or a heavy chain variable region described herein (e.g., in Table 4). In one embodiment, the CD20 binding domain comprises a heavy chain variable region described herein (e.g., in Table 4), e.g., at least two heavy chain variable regions described herein (e.g., in Table 4). In one embodiment, the CD20 binding domain is a scFv comprising a light chain and a heavy chain of an amino acid sequence of Table 1. In an embodiment, the CD20 binding domain (e.g., an scFv) comprises: a light chain variable region comprising an amino acid sequence having at least one, two or three modifications (e.g., substitutions) but not more than 30, 20 or 10 modifications (e.g., substitutions) of an amino acid sequence of a light chain variable region provided in Table 5, or a sequence with 95-99% identity with an amino acid sequence of Table 5; and/or a heavy chain variable region comprising an amino acid sequence having at least one, two or three modifications (e.g., substitutions) but not more than 30, 20 or 10 modifications (e.g., substitutions) of an amino acid sequence of a heavy chain variable region provided in Table 4, or a sequence with 95-99% identity to an amino acid sequence of Table 4. In one embodiment, the CD20 binding domain comprises a sequence selected from a group consisting of SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429, or a sequence with 95-99% identity thereof. In one embodiment, the CD20 binding domain is a scFv, and a light chain variable region comprising an amino acid sequence described herein, e.g., in Table 5, is attached to a heavy chain variable region comprising an amino acid sequence described herein, e.g., in Table 4, via a linker, e.g., a linker described herein. In one embodiment, the CD20 binding domain includes a $(Gly_4\text{-}Ser)_n$ linker, wherein n is 1, 2, 3, 4, 5, or 6, preferably 3 or 4 (SEQ ID NO: 1089). The light chain variable region and heavy chain variable region of a scFv can be, e.g., in any of the following orientations: light chain variable region-linker-heavy chain variable region or heavy chain variable region-linker-light chain variable region.

A humanized antibody can be produced using a variety of techniques known in the art, including but not limited to, CDR-grafting (see, e.g., European Patent No. EP 239,400; International Publication No. WO 91/09967; and U.S. Pat. Nos. 5,225,539, 5,530,101, and 5,585,089, each of which is incorporated herein in its entirety by reference), veneering or resurfacing (see, e.g., European Patent Nos. EP 592,106 and EP 519,596; Padlan, 1991, Molecular Immunology, 28(4/5):489-498; Studnicka et al., 1994, Protein Engineering, 7(6):805-814; and Roguska et al., 1994, PNAS, 91:969-973, each of which is incorporated herein by its entirety by reference), chain shuffling (see, e.g., U.S. Pat. No. 5,565,332, which is incorporated herein in its entirety by reference), and techniques disclosed in, e.g., U.S. Patent Application Publication No. US2005/0042664, U.S. Patent Application Publication No. US2005/0048617, U.S. Pat. Nos. 6,407,213, 5,766,886, International Publication No. WO 9317105, Tan et al., J. Immunol., 169:1119-25 (2002), Caldas et al., Protein Eng., 13(5):353-60 (2000), Morea et al., Methods, 20(3):267-79 (2000), Baca et al., J. Biol. Chem., 272(16):10678-84 (1997), Roguska et al., Protein Eng., 9(10):895-904 (1996), Couto et al., Cancer Res., 55 (23 Supp):5973s-5977s (1995), Couto et al., Cancer Res., 55(8):1717-22 (1995), Sandhu J S, Gene, 150(2):409-10 (1994), and Pedersen et al., J. Mol. Biol., 235(3):959-73 (1994), each of which is incorporated herein in its entirety by reference. Often, framework residues in the framework regions will be substituted with the corresponding residue from the CDR donor antibody to alter, for example, improve, antigen binding. These framework substitutions are identified by methods well-known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Riechmann et al., 1988, Nature, 332:323, which are incorporated herein by reference in their entireties.)

A humanized antibody or antibody fragment has one or more amino acid residues remaining in it from a source that is nonhuman. These nonhuman amino acid residues are often referred to as "import" residues, which are typically taken from an "import" variable domain. As provided herein, humanized antibodies or antibody fragments comprise one or more CDRs from nonhuman immunoglobulin molecules and framework regions wherein the amino acid residues comprising the framework are derived completely or mostly from human germline. Multiple techniques for humanization of antibodies or antibody fragments are well-known in the art and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816,567; 6,331,415; 5,225,539; 5,530,101; 5,585,089; 6,548,640, the contents of which are incorporated herein by reference herein in their entirety). In such humanized antibodies and antibody fragments, substantially less than an intact human variable domain has been substituted by the corresponding sequence from a nonhuman species. Humanized antibodies are often human antibodies in which some CDR residues and possibly some framework (FR) residues are substituted by residues from analogous sites in rodent antibodies. Humanization of antibodies and antibody fragments can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332), the contents of which are incorporated herein by reference herein in their entirety.

The choice of human variable domains, both light and heavy, to be used in making the humanized antibodies is to reduce antigenicity. According to the so-called "best-fit" method, the sequence of the variable domain of a rodent antibody is screened against the entire library of known human variable-domain sequences. The human sequence that is closest to that of the rodent is then accepted as the human framework (FR) for the humanized antibody (Sims et al., J. Immunol., 151:2296 (1993); Chothia et al., J. Mol. Biol., 196:901 (1987), the contents of which are incorporated herein by reference herein in their entirety). Another method uses a particular framework derived from the consensus sequence of all human antibodies of a particular subgroup of light or heavy chains. The same framework may be used for several different humanized antibodies (see, e.g., Nicholson et al. Mol. Immun. 34 (16-17): 1157-1165 (1997); Carter et al., Proc. Natl. Acad. Sci. USA, 89:4285 (1992); Presta et al., J. Immunol., 151:2623 (1993), the contents of which are incorporated herein by reference herein in their entirety). In one embodiment, the framework region can comprise, one, two, three, four or five modifications, e.g., substitutions, e.g., from the amino acid at the corresponding murine sequence.

In some aspects, the portion of a CAR composition of the invention that comprises an antibody fragment is humanized with retention of high affinity for the target antigen and other favorable biological properties. According to one aspect of the invention, humanized antibodies and antibody fragments are prepared by a process of analysis of the parental sequences and various conceptual humanized products using three-dimensional models of the parental and humanized sequences. Three-dimensional immunoglobulin models are commonly available and are familiar to those skilled in the art. Computer programs are available that illustrate and display probable three-dimensional conformational structures of selected candidate immunoglobulin sequences. Inspection of these displays permits analysis of the likely role of the residues in the functioning of the candidate immunoglobulin sequence, e.g., the analysis of residues that influence the ability of the candidate immunoglobulin to bind the target antigen. In this way, FR residues can be selected and combined from the recipient and import sequences so that the desired antibody or antibody fragment characteristic, such as increased affinity for the target antigen, is achieved. In general, the CDR residues are directly and most substantially involved in influencing antigen binding.

A humanized antibody or antibody fragment may retain a similar antigenic specificity as the original antibody, e.g., in the present invention, the ability to bind human CD20 or a fragment thereof. In some embodiments, a humanized antibody or antibody fragment may have improved affinity and/or specificity of binding to human CD20 or a fragment thereof.

In one aspect, the antigen binding domain portion comprises one or more sequence selected from SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429. In one aspect, the CD20 binding domain is characterized by particular functional features or properties of an antibody or antibody fragment. For example, in one aspect, the portion of a CAR composition of the invention that comprises an antigen binding domain specifically binds human CD20 or a fragment thereof. In one aspect, the invention relates to an antigen binding domain comprising an antibody or antibody fragment, wherein the antibody binding domain specifically binds to a CD20 protein or fragment thereof, wherein the antibody or antibody fragment comprises a variable light chain and/or a variable heavy chain that includes an amino acid sequence selected from Table 1. In one aspect, the antigen binding domain comprises an amino acid sequence of a scFv selected from SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429. In certain aspects, the scFv is contiguous with and in the same reading frame as a leader sequence. In one aspect the leader sequence is the polypeptide sequence provided as SEQ ID NO: 797.

In one aspect, the CD20 binding domain is a fragment, e.g., a single chain variable fragment (scFv). In one aspect, the CD20 binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a CD20 protein or a fragment thereof with wild-type or enhanced affinity.

In some instances, a human scFv can be derived from a display library. A display library is a collection of entities; each entity includes an accessible polypeptide component and a recoverable component that encodes or identifies the polypeptide component. The polypeptide component is varied so that different amino acid sequences are represented. The polypeptide component can be of any length, e.g. from three amino acids to over 300 amino acids. A display library entity can include more than one polypeptide component, for example, the two polypeptide chains of a Fab. In one exemplary embodiment, a display library can be used to identify a human CD20 binding domain. In a selection, the polypeptide component of each member of the library is probed with CD20, or a fragment thereof, and if the polypeptide component binds to CD20, the display library member is identified, typically by retention on a support.

Retained display library members are recovered from the support and analyzed. The analysis can include amplification and a subsequent selection under similar or dissimilar conditions. For example, positive and negative selections can be alternated. The analysis can also include determining the amino acid sequence of the polypeptide component, i.e., the anti-CD20 binding domain, and purification of the polypeptide component for detailed characterization.

A variety of formats can be used for display libraries. Examples include the phage display. In phage display, the protein component is typically covalently linked to a bacteriophage coat protein. The linkage results from translation of a nucleic acid encoding the protein component fused to the coat protein. The linkage can include a flexible peptide linker, a protease site, or an amino acid incorporated as a result of suppression of a stop codon. Phage display is described, for example, in U.S. Pat. No. 5,223,409; Smith (1985) *Science* 228:1315-1317; WO 92/18619; WO 91/17271; WO 92/20791; WO 92/15679; WO 93/01288; WO 92/01047; WO 92/09690; WO 90/02809; de Haard et al. (1999) *J. Biol. Chem* 274:18218-30; Hoogenboom et al. (1998) *Immunotechnology* 4:1-20; Hoogenboom et al. (2000) *Immunol Today* 2:371-8 and Hoet et al. (2005) *Nat Biotechnol.* 23(3)344-8. Bacteriophage displaying the protein component can be grown and harvested using standard phage preparatory methods, e.g. PEG precipitation from growth media. After selection of individual display phages, the nucleic acid encoding the selected protein components can be isolated from cells infected with the selected phages or from the phage themselves, after amplification. Individual colonies or plaques can be picked, the nucleic acid isolated and sequenced.

Other display formats include cell based display (see, e.g., WO 03/029456), protein-nucleic acid fusions (see, e.g., U.S. Pat. No. 6,207,446), ribosome display (See, e.g., Mattheakis et al. (1994) *Proc. Natl. Acad. Sci. USA* 91:9022 and Hanes et al. (2000) *Nat Biotechnol.* 18:1287-92; Hanes et al. (2000) *Methods Enzymol.* 328:404-30; and Schaffitzel et al. (1999) *J Immunol Methods.* 231(1-2): 119-35), and *E. coli* periplasmic display (2005 Nov. 22; PMID: 16337958).

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as (Gly$_4$Ser)n (SEQ ID NO: 1090), where n is a positive integer equal to or greater than 1. In one embodiment, the linker can be (Gly$_4$Ser)$_4$ (SEQ ID NO: 23) or (Gly$_4$Ser)$_3$ (SEQ ID NO: 541). Variation in the linker length may retain or enhance activity, giving rise to superior efficacy in activity studies.

Stability and Mutations

The stability of a CD20 binding domain, e.g., scFv molecules (e.g., soluble scFv) can be evaluated in reference to the biophysical properties (e.g., thermal stability) of a conventional control scFv molecule or a full length antibody. In one embodiment, the human scFv has a thermal stability that is greater than about 0.1, about 0.25, about 0.5, about 0.75, about 1, about 1.25, about 1.5, about 1.75, about 2, about 2.5, about 3, about 3.5, about 4, about 4.5, about 5, about 5.5, about 6, about 6.5, about 7, about 7.5, about 8, about 8.5, about 9, about 9.5, about 10 degrees, about 11 degrees, about 12 degrees, about 13 degrees, about 14 degrees, or about 15 degrees Celsius than a control binding molecule (e.g. a conventional scFv molecule) in the described assays.

The improved thermal stability of the CD20 binding domain, e.g., scFv is subsequently conferred to the entire CART20 construct, leading to improved therapeutic properties of the CART20 construct. The thermal stability of the CD20 binding domain, e.g., scFv can be improved by at least about 2° C. or 3° C. as compared to a conventional antibody. In one embodiment, the CD20 binding domain, e.g., scFv has a 1° C. improved thermal stability as compared to a conventional antibody. In another embodiment, the CD20 binding domain, e.g., scFv has a 2° C. improved thermal stability as compared to a conventional antibody. In another embodiment, the scFv has a 4, 5, 6, 7, 8, 9, 10, 11, 12, 13, 14, 15° C. improved thermal stability as compared to a conventional antibody. Comparisons can be made, for example, between the scFv molecules disclosed herein and full length antibodies. Thermal stability can be measured using methods known in the art. For example, in one embodiment, Tm can be measured. Methods for measuring Tm and other methods of determining protein stability are described in more detail below.

Mutations in scFv alter the stability of the scFv and improve the overall stability of the scFv and the CART20 construct. Stability of a murine, humanized or human scFv is determined using measurements such as Tm, temperature denaturation and temperature aggregation.

In one embodiment, the CD20 binding domain, e.g., scFv comprises at least one mutation such that the mutated scFv confers improved stability to the CART20 construct. In another embodiment, the CD20 binding domain, e.g., scFv comprises at least 1, 2, 3, 4, 5, 6, 7, 8, 9, 10 mutations arising from the humanization process such that the mutated scFv confers improved stability to the CART20 construct.

Methods of Evaluating Protein Stability

The stability of an antigen binding domain may be assessed using, e.g., the methods described below. Such methods allow for the determination of multiple thermal unfolding transitions where the least stable domain either unfolds first or limits the overall stability threshold of a multidomain unit that unfolds cooperatively (e.g., a multidomain protein which exhibits a single unfolding transition). The least stable domain can be identified in a number of additional ways. Mutagenesis can be performed to probe which domain limits the overall stability. Additionally, protease resistance of a multidomain protein can be performed under conditions where the least stable domain is known to be intrinsically unfolded via DSC or other spectroscopic methods (Fontana, et al., (1997) Fold. Des., 2: R17-26; Dimasi et al. (2009) J. Mol. Biol. 393: 672-692). Once the least stable domain is identified, the sequence encoding this domain (or a portion thereof) may be employed as a test sequence in the methods.

a) Thermal Stability

The thermal stability of the compositions may be analyzed using a number of non-limiting biophysical or biochemical techniques known in the art. In certain embodiments, thermal stability is evaluated by analytical spectroscopy.

An exemplary analytical spectroscopy method is Differential Scanning Calorimetry (DSC). DSC employs a calorimeter which is sensitive to the heat absorbances that accompany the unfolding of most proteins or protein domains (see, e.g. Sanchez-Ruiz, et al., Biochemistry, 27: 1648-52, 1988). To determine the thermal stability of a protein, a sample of the protein is inserted into the calorimeter and the temperature is raised until the Fab or scFv unfolds. The temperature at which the protein unfolds is indicative of overall protein stability.

Another exemplary analytical spectroscopy method is Circular Dichroism (CD) spectroscopy. CD spectrometry measures the optical activity of a composition as a function of increasing temperature. Circular dichroism (CD) spectroscopy measures differences in the absorption of left-handed polarized light versus right-handed polarized light which arise due to structural asymmetry. A disordered or unfolded structure results in a CD spectrum very different from that of an ordered or folded structure. The CD spectrum reflects the sensitivity of the proteins to the denaturing effects of increasing temperature and is therefore indicative of a protein's thermal stability (see van Mierlo and Steemsma, J. Biotechnol., 79(3):281-98, 2000).

Another exemplary analytical spectroscopy method for measuring thermal stability is Fluorescence Emission Spectroscopy (see van Mierlo and Steemsma, supra). Yet another exemplary analytical spectroscopy method for measuring thermal stability is Nuclear Magnetic Resonance (NMR) spectroscopy (see, e.g. van Mierlo and Steemsma, supra).

The thermal stability of a composition can be measured biochemically. An exemplary biochemical method for assessing thermal stability is a thermal challenge assay. In a "thermal challenge assay", a composition is subjected to a range of elevated temperatures for a set period of time. For example, in one embodiment, test scFv molecules or molecules comprising scFv molecules are subject to a range of increasing temperatures, e.g., for 1-1.5 hours. The activity of the protein is then assayed by a relevant biochemical assay. For example, if the protein is a binding protein (e.g. an scFv or scFv-containing polypeptide) the binding activity of the binding protein may be determined by a functional or quantitative ELISA.

Such an assay may be done in a high-throughput format and those disclosed in the Examples using *E. coli* and high throughput screening. A library of CD20 binding domains, e.g., scFv variants may be created using methods known in the art. CD20 binding domains, e.g., scFv expression may be induced and the CD20 binding domains, e.g., scFv may be subjected to thermal challenge. The challenged test samples may be assayed for binding and those CD20 binding domains, e.g., scFvs which are stable may be scaled up and further characterized.

Thermal stability is evaluated by measuring the melting temperature (Tm) of a composition using any of the above techniques (e.g. analytical spectroscopy techniques). The melting temperature is the temperature at the midpoint of a thermal transition curve wherein 50% of molecules of a composition are in a folded state (See e.g., Dimasi et al. (2009) J. Mol Biol. 393: 672-692). In one embodiment, Tm values for a CD20 binding domain, e.g., scFv are about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an IgG is about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an multivalent antibody is about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C.

Thermal stability is also evaluated by measuring the specific heat or heat capacity (Cp) of a composition using an analytical calorimetric technique (e.g. DSC). The specific heat of a composition is the energy (e.g. in kcal/mol) is required to rise by 1° C., the temperature of 1 mol of water. As large Cp is a hallmark of a denatured or inactive protein composition. The change in heat capacity (ΔCp) of a composition is measured by determining the specific heat of a composition before and after its thermal transition. Thermal stability may also be evaluated by measuring or determining other parameters of thermodynamic stability including Gibbs free energy of unfolding (ΔG), enthalpy of unfolding (ΔH), or entropy of unfolding (ΔS). One or more of the above biochemical assays (e.g. a thermal challenge assay) are used to determine the temperature (i.e. the $T_C$ value) at which 50% of the composition retains its activity (e.g. binding activity).

In addition, mutations to the CD20 binding domain, e.g., scFv alter the thermal stability of the CD20 binding domain, e.g., scFv compared with the unmutated CD20 binding domain, e.g., scFv. When the murine, humanized or human CD20 binding domain, e.g., scFv is incorporated into a CART20 construct, the CD20 binding domain, e.g., murine, humanized or human scFv confers thermal stability to the overall CD20 CART construct. In one embodiment, the CD20 binding domain, e.g., scFv comprises a single mutation that confers thermal stability to the CD20 binding domain, e.g., scFv. In another embodiment, the CD20 binding domain, e.g., scFv comprises multiple mutations that confer thermal stability to the CD20 binding domain, e.g., scFv. In one embodiment, the multiple mutations in the CD20 binding domain, e.g., scFv have an additive effect on thermal stability of the CD20 binding domain, e.g., scFv.

b) % Aggregation

The stability of a composition can be determined by measuring its propensity to aggregate. Aggregation can be measured by a number of non-limiting biochemical or biophysical techniques. For example, the aggregation of a composition may be evaluated using chromatography, e.g. Size-Exclusion Chromatography (SEC). SEC separates molecules on the basis of size. A column is filled with semi-solid beads of a polymeric gel that will admit ions and small molecules into their interior but not large ones. When a protein composition is applied to the top of the column, the compact folded proteins (i.e. non-aggregated proteins) are distributed through a larger volume of solvent than is available to the large protein aggregates. Consequently, the large aggregates move more rapidly through the column, and in this way the mixture can be separated or fractionated into its components. Each fraction can be separately quantified (e.g. by light scattering) as it elutes from the gel. Accordingly, the % aggregation of a composition can be determined by comparing the concentration of a fraction with the total concentration of protein applied to the gel. Stable compositions elute from the column as essentially a single fraction and appear as essentially a single peak in the elution profile or chromatogram.

c) Binding Affinity

The stability of a composition can be assessed by determining its target binding affinity. A wide variety of methods for determining binding affinity are known in the art. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). For further descriptions, see Jonsson, U., et al. (1993) Ann. Biol. Clin. 51:19-26; Jonsson, U., i (1991) Biotechniques 11:620-627; Johnsson, B., et al. (1995) J. Mol. Recognit. 8:125-131; and Johnnson, B., et al. (1991) Anal. Biochem. 198:268-277.

In one aspect, the antigen binding domain of the CAR comprises an amino acid sequence that is homologous to an antigen binding domain amino acid sequence described herein, and the antigen binding domain retains the desired functional properties of the CD20 antibody fragments described herein. In one specific aspect, the CAR composition of the invention comprises an antibody fragment. In a further aspect, that antibody fragment comprises an scFv.

In various aspects, the antigen binding domain of the CAR is engineered by modifying one or more amino acids within one or both variable regions (e.g., VH and/or VL), for example within one or more CDR regions and/or within one or more framework regions. In one specific aspect, the CAR composition of the invention comprises an antibody fragment. In a further aspect, that antibody fragment comprises an scFv.

It will be understood by one of ordinary skill in the art that the antibody or antibody fragment of the invention may further be modified such that they vary in amino acid sequence (e.g., from wild-type), but not in desired activity. For example, additional nucleotide substitutions leading to amino acid substitutions at "non-essential" amino acid residues may be made to the protein For example, a nonessential amino acid residue in a molecule may be replaced with another amino acid residue from the same side chain family. In another embodiment, a string of amino acids can be replaced with a structurally similar string that differs in order and/or composition of side chain family members, e.g., a conservative substitution, in which an amino acid residue is replaced with an amino acid residue having a similar side chain, may be made.

Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Percent identity in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

In one aspect, the present invention contemplates modifications of the starting antibody or fragment (e.g., scFv) amino acid sequence that generate functionally equivalent molecules. For example, the VH or VL of a CD20 binding domain, e.g., scFv, comprised in the CAR can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting VH or VL framework region of the CD20 binding domain, e.g., scFv. The present invention contemplates modifications of the entire CAR construct, e.g., modifications in one or more amino acid sequences of the various domains of the CAR construct in order to generate functionally equivalent molecules. The CAR construct can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting CAR construct.

Bispecific CARs

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv, or fragment thereof, have binding specificity for a first epitope and a scFv, or fragment thereof, have binding specificity for a second epitope. In an embodiment the first epitope is located on CD19 and the second epitope is located on CD20, C22, or ROR1.

In certain embodiments, the antibody molecule is a multispecific (e.g., a bispecific or a trispecific) antibody molecule. Protocols for generating bispecific or heterodimeric antibody molecules are known in the art; including but not limited to, for example, the "knob in a hole" approach described in, e.g., U.S. Pat. No. 5,731,168; the electrostatic steering Fc pairing as described in, e.g., WO 09/089004, WO 06/106905 and WO 2010/129304; Strand Exchange Engineered Domains (SEED) heterodimer formation as described in, e.g., WO 07/110205; Fab arm exchange as described in, e.g., WO 08/119353, WO 2011/131746, and WO 2013/060867; double antibody conjugate, e.g., by antibody cross-linking to generate a bi-specific structure using a heterobifunctional reagent having an amine-reactive group and a sulfhydryl reactive group as described in, e.g., U.S. Pat. No. 4,433,059; bispecific antibody determinants generated by recombining half antibodies (heavy-light chain pairs or Fabs) from different antibodies through cycle of reduction and oxidation of disulfide bonds between the two heavy chains, as described in, e.g., U.S. Pat. No. 4,444,878; trifunctional antibodies, e.g., three Fab' fragments crosslinked through sulfhydryl reactive groups, as described in, e.g., U.S. Pat. No. 5,273,743; biosynthetic binding proteins, e.g., pair of scFvs cross-linked through C-terminal tails preferably through disulfide or amine-reactive chemical cross-linking, as described in, e.g., U.S. Pat. No. 5,534,254; bifunctional antibodies, e.g., Fab fragments with different binding specificities dimerized through leucine zippers (e.g., c-fos and c-jun) that have replaced the constant domain, as described in, e.g., U.S. Pat. No. 5,582,996; bispecific and oligospecific mono- and oligovalent receptors, e.g., VH-CH1 regions of two antibodies (two Fab fragments) linked through a polypeptide spacer between the CH1 region of one antibody and the VH region of the other antibody typically with associated light chains, as described in, e.g., U.S. Pat. No. 5,591,828; bispecific DNA-antibody conjugates, e.g., crosslinking of antibodies or Fab fragments through a double stranded piece of DNA, as described in, e.g., U.S. Pat. No. 5,635,602; bispecific fusion proteins, e.g., an expression construct containing two scFvs with a hydrophilic helical peptide linker between them and a full constant region, as described in, e.g., U.S. Pat. No. 5,637,481; multivalent and multispecific binding proteins, e.g., dimer of polypeptides having first domain with binding region of Ig heavy chain variable region, and second domain with binding region of Ig light chain variable region, generally termed diabodies (higher order structures are also encompassed creating for bispecific, trispecific, or tetraspecific molecules, as described in, e.g., U.S. Pat. No. 5,837,242; minibody constructs with linked VL and VH chains further connected with peptide spacers to an antibody hinge region and CH3 region, which can be dimerized to form bispecific/multivalent molecules, as described in, e.g., U.S. Pat. No. 5,837,821; VH and VL domains linked with a short peptide linker (e.g., 5 or 10 amino acids) or no linker at all in either orientation, which can form dimers to form bispecific diabodies; trimers and tetramers, as described in, e.g., U.S. Pat. No. 5,844,094; String of VH domains (or VL domains in family members) connected by peptide linkages with cross-linkable groups at the C-terminus further associated with VL domains to form a series of FVs (or scFvs), as described in, e.g., U.S. Pat. No. 5,864,019; and single chain binding polypeptides with both a VH and a VL domain linked through a peptide linker are combined into multivalent structures through non-covalent or chemical crosslinking to form, e.g., homobivalent, heterobivalent, trivalent, and tetravalent structures using both scFV or diabody type format, as described in, e.g., U.S. Pat. No. 5,869,620. Additional exemplary multispecific and bispecific molecules and methods of making the same are found, for example, in U.S. Pat. Nos. 5,910,573, 5,932,448, 5,959,083, 5,989,830, 6,005,079, 6,239,259, 6,294,353, 6,333,396, 6,476,198, 6,511,663, 6,670,453, 6,743,896, 6,809,185, 6,833,441, 7,129,330, 7,183,076, 7,521,056, 7,527,787, 7,534,866, 7,612,181, US2002004587A1, US2002076406A1, US2002103345A1, US2003207346A1, US2003211078A1, US2004219643A1, US2004220388A1, US2004242847A1, US2005003403A1, US2005004352A1, US2005069552A1, US2005079170A1, US2005100543A1, US2005136049A1, US2005136051A1, US2005163782A1, US2005266425A1, US2006083747A1, US2006120960A1, US2006204493A1, US2006263367A1, US2007004909A1, US2007087381A1, US2007128150A1, US2007141049A1, US2007154901A1, US2007274985A1, US2008050370A1, US2008069820A1, US2008152645A1, US2008171855A1, US2008241884A1, US2008254512A1, US2008260738A1, US2009130106A1, US2009148905A1, US2009155275A1, US2009162359A1, US2009162360A1, US2009175851A1, US2009175867A1, US2009232811A1, US2009234105A1, US2009263392A1, US2009274649A1, EP346087A2, WO0006605A2, WO02072635A2, WO04081051A1, WO06020258A2, WO2007044887A2, WO2007095338A2, WO2007137760A2, WO2008119353A1, WO2009021754A2, WO2009068630A1, WO9103493A1, WO9323537A1, WO9409131A1, WO9412625A2, WO9509917A1, WO9637621A2, WO9964460A1. The contents of the above-referenced applications are incorporated herein by reference in their entireties.

Exemplary Multispecific Molecules

In some embodiments, the antibody molecule is a multi-specific, e.g., bispecific, antibody molecule comprising one, two, or more binding specificities, e.g., a first binding specificity for a first antigen, e.g., a B-cell epitope, and a second binding specificity for the same or a different antigen, e.g., B cell epitope.

In one embodiment, the first and second binding specificity is an antibody molecule, e.g., an antigen binding domain (e.g., a scFv). Within each antibody molecule (e.g., scFv) of a bispecific antibody molecule, the VH can be upstream or downstream of the VL. In some embodiments, the upstream antibody or antibody fragment (e.g., scFv) is arranged with its VH ($VH_1$) upstream of its VL ($VL_1$) and the downstream antibody or antibody fragment (e.g., scFv) is arranged with its VL ($VL_2$) upstream of its VH ($VH_2$), such that the overall bispecific antibody molecule has the arrangement $VH_1$-$VL_1$-$VL_2$-$VH_2$, from an N- to C-terminal orientation.

In some embodiments, the upstream antibody or antibody fragment or antigen binding domain (e.g., scFv) is arranged with its VL ($VL_1$) upstream of its VH ($VH_1$) and the downstream antibody or antibody fragment (e.g., scFv) is arranged with its VH ($VH_2$) upstream of its VL ($VL_2$), such that the overall bispecific antibody molecule has the arrangement $VL_1$-$VH_1$-$VH_2$-$VL_2$, from an N- to C-terminal orientation.

In some embodiments, the upstream antibody or antibody fragment (e.g., scFv) is arranged with its VL ($VL_1$) upstream of its VH ($VH_1$) and the downstream antibody or antibody fragment or antigen binding domain (e.g., scFv) is arranged with its VL ($VL_2$) upstream of its VH ($VH_2$), such that the overall bispecific antibody molecule has the arrangement $VL_1$-$VH_1$-$VL_2$-$VH_2$, from an N- to C-terminal orientation.

In some embodiments, the upstream antibody or antibody fragment or antigen binding domain (e.g., scFv) is arranged with its VH ($VH_1$) upstream of its VL ($VL_1$) and the downstream antibody or antibody fragment (e.g., scFv) is arranged with its VH ($VH_2$) upstream of its VL ($VL_2$), such that the overall bispecific antibody molecule has the arrangement $VH_1$-$VL_1$-$VH_2$-$VL_2$, from an N- to C-terminal orientation.

In any of the aforesaid configurations, optionally, a linker is disposed between the two antibodies or antibody fragments or antigen binding domains (e.g., scFvs), e.g., between $VL_1$ and $VL_2$ if the construct is arranged as $VH_1$-$VL_1$-$VL_2$-$VH_2$; between $VH_1$ and $VH_2$ if the construct is arranged as $VL_1$-$VH_1$-$VH_2$-$VL_2$; between $VH_1$ and $VL_2$ if the construct is arranged as $VL_1$-$VH_1$-$VL_2$-$VH_2$; or between $VL_1$ and $VH_2$ if the construct is arranged as $VH_1$-$VL_1$-$VH_2$-$VL_2$. In general, the linker between the two antibody fragments or antigen binding domains, e.g., scFvs, should be long enough to avoid mispairing between the domains of the two scFvs. The linker may be a linker as described herein. In some embodiments, the linker is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 841). In some embodiments, the linker is $(Gly_4$-$Ser)_n$, wherein n=4 (SEQ ID NO: 23). In, the linker comprises, e.g., consists of, the amino acid sequence: LAEAAAK (SEQ ID NO: 1091).

In any of the aforesaid configurations, optionally, a linker is disposed between the VL and VH of the first antigen binding domains, e.g., scFv. Optionally, a linker is disposed between the VL and VH of the second antigen binding domains, e.g., scFv. In constructs that have multiple linkers, any two or more of the linkers can be the same or different. Accordingly, in some embodiments, a bispecific CAR comprises VLs, VHs, and optionally one or more linkers in an arrangement as described herein.

In some embodiments, each antibody molecule, e.g., each antigen binding domain (e.g., each scFv) comprises a linker between the VH and the VL regions. In some embodiments, the linker between the VH and the VL regions is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In other embodiments, the linker is $(Gly_4$-$Ser)_n$, wherein n=3 (SEQ ID NO: 1084). In some embodiments, the linker is $(Gly_4$-$Ser)_n$, wherein n=4 (SEQ ID NO: 23). In some embodiments, the VH and VL regions are connected without a linker.

In certain embodiments, the antibody molecule is a bispecific antibody molecule having a first binding specificity for a first B-cell epitope and a second binding specificity for the same or a different B-cell antigen. For instance, in some embodiments the bispecific antibody molecule has a first binding specificity for CD20 and a second binding specificity for one or more of CD10, CD19, CD20, CD22, CD34, CD123, FLT-3, ROR1, CD79b, CD179b, or CD79a. In some embodiments the bispecific antibody molecule has a first binding specificity for CD19 and a second binding specificity for CD20. In some embodiments the bispecific antibody molecule has a first binding specificity for CD19 and a second binding specificity for CD22.

In one embodiment, the antibody molecule is a bispecific antibody molecule having a binding specificity, e.g., a first and/or second binding specificity, to CD19. In one embodiment, the binding specificity is configured with its VL ($VL_1$) upstream of its VH ($VH_1$) and the downstream antibody or antibody fragment or antigen binding domains (e.g., scFv) is arranged with its VL ($VL_2$) upstream of its VH ($VH_2$), such that the overall bispecific antibody molecule has the arrangement $VL_1$-$VH_1$-$VL_2$-$VH_2$, from an N- to C-terminal orientation. In one embodiment, the CD19 binding specificity comprises a VH and VL as depicted in Table 11, e.g., a CTL019 scFv (SEQ ID NO: 765). In some embodiments, the CD19 binding specificity comprises a VH and VL as depicted in Table 11, e.g., a humanized CD19 scFv, e.g., a humanized CAR2. In some embodiments, the first and/or second binding specificity, to CD19 (e.g., first and/or second scFv to CD19) comprises a linker between the VH and the VL regions. In some embodiments, the linker between the VH and the VL regions is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 1084). In some embodiments, the linker is $(Gly_4$-$Ser)_n$, wherein n=4 (SEQ ID NO: 23). In some embodiments, the VH and VL regions are connected without a linker.

In another embodiment, the binding specificity, e.g., a first and/or second binding specificity, to CD19 is configured with its VL ($VL_1$) upstream of its VH ($VH_1$) and the downstream antibody or antibody fragment or antigen binding domains (e.g., scFv) is arranged with its VH ($VH_2$) upstream of its VL ($VL_2$), such that the overall bispecific antibody molecule has the arrangement $VL_1$-$VH_1$-$VH_2$-$VL_2$, from an N- to C-terminal orientation. In one embodiment, the CD19 binding specificity comprises a VH and VL as depicted in Table 11, e.g., a CTL019 scFv (SEQ ID NO: 765). In some embodiments, the CD19 binding specificity comprises a VH and VL as depicted in Table 11, e.g., a humanized CD19 scFv, e.g., a humanized CAR2. In some embodiments, the first and/or second binding specificity, to CD19 (e.g., first and/or second scFv to CD19) comprises a linker between the VH and the VL regions. In some embodiments, the linker between the VH and the VL regions is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 1084). In some embodiments, the linker is $(Gly_4$-$Ser)_n$, wherein n=4 (SEQ ID NO: 23). In some embodiments, the VH and VL regions are connected without a linker.

In another embodiment, the binding specificity, e.g., a first and/or second binding specificity, to CD19 is configured with its VH ($VH_1$) upstream of its VL ($VL_1$) and the downstream antibody or antibody fragment or antigen binding domain (e.g., scFv) is arranged with its VL ($VL_2$) upstream of its VH ($VH_2$), such that the overall bispecific antibody molecule has the arrangement $VH_1$-$VL_1$-$VL_2$-$VH_2$, from an N- to C-terminal orientation. In one embodiment, the CD19 binding specificity comprises a VH and VL as depicted in Table 11, e.g., a CTL019 scFv (SEQ ID NO: 765). In some embodiments, the CD19 binding specificity comprises a VH and VL as depicted in Table 11, e.g., a humanized CD19 scFv, e.g., a humanized CAR2. In some embodiments, the first and/or second binding specificity, to CD19 (e.g., first and/or second scFv to CD19) comprises a linker between the VH and the VL regions. In some embodiments, the linker between the VH and the VL regions is a $(Gly_4$-$Ser)_n$ linker, wherein n is 1, 2, 3, 4, 5, or 6 (SEQ ID NO: 1089). In some embodiments, the linker is $(Gly_4$-$Ser)_n$, wherein n=1 (SEQ ID NO: 1083), e.g., the linker has the amino acid sequence $Gly_4$-Ser (SEQ ID NO: 1090). In some embodiments, the linker is $(Gly_4$-$Ser)_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the binding specificity, e.g., a first and/or second binding specificity, to CD19 is configured with its VH (VH$_1$) upstream of its VL (VL$_1$) and the downstream antibody or antibody fragment or antigen binding domain (e.g., scFv) is arranged with its VH (VH$_2$) upstream of its VL (VL$_2$), such that the overall bispecific antibody molecule has the arrangement VH$_1$-VL$_1$-VH$_2$-VL$_2$, from an N- to C-terminal orientation. In one embodiment, the CD19 binding specificity comprises a VH and VL as depicted in Table 11, e.g., a CTL019 scFv (SEQ ID NO: 765). In some embodiments, the CD19 binding specificity comprises a VH and VL as depicted in Table 11, e.g., a humanized CD19 scFv, e.g., a humanized CAR2. In some embodiments, the first and/or second binding specificity, to CD19 (e.g., first and/or second scFv to CD19) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the antibody molecule is a bispecific antibody molecule having a binding specificity, e.g., a first and/or second binding specificity, to CD20. In one embodiment, the binding specificity is configured with its VL (VL$_1$) upstream of its VH (VH$_1$) and the downstream antibody or antibody fragment or antigen binding domain (e.g., scFv) is arranged with its VL (VL$_2$) upstream of its VH (VH$_2$), such that the overall bispecific antibody molecule has the arrangement VL$_1$-VH$_1$-VL$_2$-VH$_2$, from an N- to C-terminal orientation. In one embodiment, the CD20 binding specificity comprises a VH and VL as depicted in Table 1, e.g., a VH and VL from a C3H2 scFv or a C5H1 scFv. In some embodiments, the first and/or second binding specificity, to CD20 (e.g., first and/or second scFv to CD20) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the binding specificity, e.g., a first and/or second binding specificity, to CD20 is configured with its VL (VL$_1$) upstream of its VH (VH$_1$) and the downstream antibody or antibody fragment or antigen binding domain (e.g., scFv) is arranged with its VH (VH$_2$) upstream of its VL (VL$_2$), such that the overall bispecific antibody molecule has the arrangement VL$_1$-VH$_1$-VH$_2$-VL$_2$, from an N- to C-terminal orientation. In one embodiment, the CD20 binding specificity comprises a VH and VL as depicted in Table 1, e.g., a VH and VL from a C3H2 scFv or a C5H1 scFv. In some embodiments, the first and/or second binding specificity, to CD20 (e.g., first and/or second scFv to CD20) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the binding specificity, e.g., a first and/or second binding specificity, to CD20 is configured with its VH (VH$_1$) upstream of its VL (VL$_1$) and the downstream antibody or antibody fragment or antigen binding domain (e.g., scFv) is arranged with its VL (VL$_2$) upstream of its VH (VH$_2$), such that the overall bispecific antibody molecule has the arrangement VH$_1$-VL$_1$-VL$_2$-VH$_2$, from an N- to C-terminal orientation. In one embodiment, the CD22 binding specificity comprises a VH and VL as depicted in Table 1, e.g., a VH and VL from a C3H2 scFv or a C5H1 scFv. In some embodiments, the first and/or second binding specificity, to CD20 (e.g., first and/or second scFv to CD20) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the binding specificity, e.g., a first and/or second binding specificity, to CD20 is configured with its VH (VH$_1$) upstream of its VL (VL$_1$) and the downstream antibody or antibody fragment or antigen binding domain (e.g., scFv) is arranged with its VH (VH$_2$) upstream of its VL (VL$_2$), such that the overall bispecific antibody molecule has the arrangement VH$_1$-VL$_1$-VH$_2$-VL$_2$, from an N- to C-terminal orientation. In one embodiment, the CD22 binding specificity comprises a VH and VL as depicted in Table 1, e.g., a VH and VL from a C3H2 scFv or a C5H1 scFv. In some embodiments, the first and/or second binding specificity, to CD20 (e.g., first and/or second scFv to CD20) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 1084). In some embodiments, the linker is (Gly$_4$-Ser)$_n$, wherein n=4 (SEQ ID NO: 23). In some embodiments, the VH and VL regions are connected without a linker.

In another embodiment, the antibody molecule is a bispecific antibody molecule having a binding specificity, e.g., a first and/or second binding specificity, to CD22. In one embodiment, the binding specificity is configured with its VL (VL$_1$) upstream of its VH (VH$_1$) and the downstream antibody or antibody fragment or antigen binding domain (e.g., scFv) is arranged with its VL (VL$_2$) upstream of its VH (VH$_2$), such that the overall bispecific antibody molecule has the arrangement VL$_1$-VH$_1$-VL$_2$-VH$_2$, from an N- to C-terminal orientation. In one embodiment, the CD22 binding specificity comprises a VH and VL as depicted in Table 6, e.g., a VH and VL from a CD22-65 or CD22-65KD scFv. In some embodiments, the first and/or second binding specificity, to CD22 (e.g., first and/or second scFv to CD22) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In another embodiment, the binding specificity, e.g., a first and/or second binding specificity, to CD22 is configured with its VL (VL$_1$) upstream of its VH (VH$_1$) and the downstream antibody or antibody fragment or antigen binding domain (e.g., scFv) is arranged with its VH (VH$_2$) upstream of its VL (VL$_2$), such that the overall bispecific antibody molecule has the arrangement VL$_1$-VH$_1$-VH$_2$-VL$_2$, from an N- to C-terminal orientation. In one embodiment, the CD22 binding specificity comprises a VH and VL as depicted in Table 6, e.g., a VH and VL from a CD22-65 or CD22-65KD scFv. In some embodiments, the first and/or second binding specificity, to CD22 (e.g., first and/or second scFv to CD22) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In another embodiment, the binding specificity, e.g., a first and/or second binding specificity, to CD22 is configured with its VH (VH$_1$) upstream of its VL (VL$_1$) and the downstream antibody or antibody fragment or antigen binding domain (e.g., scFv) is arranged with its VL (VL$_2$) upstream of its VH (VH$_2$), such that the overall bispecific antibody molecule has the arrangement VH$_1$-VL$_1$-VL$_2$-VH$_2$, from an N- to C-terminal orientation. In one embodiment, the CD22 binding specificity comprises a VH and VL as depicted in Table 6, e.g., a VH and VL from a CD22-65 or CD22-65KD scFv. In some embodiments, the first and/or second binding specificity, to CD22 (e.g., first and/or second scFv to CD22) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In another embodiment, the binding specificity, e.g., a first and/or second binding specificity, to CD22 is configured with its VH (VH$_1$) upstream of its VL (VL$_1$) and the downstream antibody or antibody fragment or antigen binding domain (e.g., scFv) is arranged with its VH (VH$_2$) upstream of its VL (VL$_2$), such that the overall bispecific antibody molecule has the arrangement VH$_1$-VL$_1$-VH$_2$-VL$_2$, from an N- to C-terminal orientation. In one embodiment, the CD22 binding specificity comprises a VH and VL as depicted in Table 6, e.g., a VH and VL from a CD22-65 or CD22-65KD scFv. In some embodiments, the first and/or second binding specificity, to CD22 (e.g., first and/or second scFv to CD22) comprises a linker between the VH and the VL regions. In some embodiments, the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In some embodiments, the bispecific antibody molecule comprises a first binding specificity to CD19, e.g., any of the binding specificities to CD19 described herein, and a second binding specificity to CD22, e.g., any of the binding specificities to CD22 as described herein. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises, e.g., consists of, the amino acid sequence: LAEAAAK (SEQ ID NO: 1091).

In one embodiment, the bispecific antibody molecule comprises a first binding specificity to CD19, e.g., a VL1-VH1 binding specificity to CD19, and a second binding specificity to CD22, e.g., a VL2-VH2 or VH2-VL1 binding specificity to CD22. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises, e.g., consists of, the amino acid sequence: LAEAAAK (SEQ ID NO: 1091).

In one embodiment, the bispecific antibody molecule comprises a first binding specificity to CD22, e.g., a VL2-VH2 or VH2-VL1 binding specificity to CD22, and a second binding specificity to CD19, e.g., a VL1-VH1 binding specificity to CD19. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises, e.g., consists of, the amino acid sequence: LAEAAAK (SEQ ID NO: 1091).

Two or more antibody molecules, e.g., as described herein, can be linked providing multispecific antibody molecules, e.g., bi-, tri or more antibody molecules.

Figure 27:
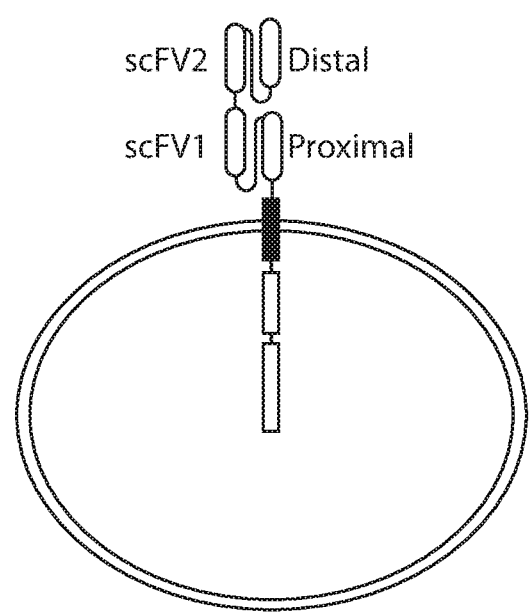
FIG. 27 is a schematic showing the distal and proximal end of an exemplary tandem CAR construct.

In some embodiments, any of the aforesaid multispecific, e.g., bispecific, antibody molecules is present in a CAR molecule as described herein. In embodiments, CAR molecule comprises a bispecific CAR comprising a first and second binding specificities, e.g., as described herein (e.g., two antibody molecules, e.g., two scFvs as described herein). In some embodiments, the bispecific CAR comprises two antibody molecules, wherein the first binding specificity, e.g., the first antibody molecule (e.g., the first antigen binding domain, e.g., the first scFv) is closer to the transmembrane domain, also referred to herein as the proximal antibody molecule (e.g., proximal antigen binding domain) and the second binding specificity, e.g., the second antibody molecule (e.g., second antigen binding domain, e.g., the second scFv) is further away from the membrane, also referred to herein as the distal antibody molecule (e.g., the distal antigen binding domain). Thus, from N-to-C-terminus, the CAR molecule comprises a distal binding specificity, e.g., a distal antibody molecule (e.g., a distal antigen binding domain, e.g., a distal scFV or scFv2), optionally, a linker, followed by a proximal binding specificity, e.g., a proximal antibody molecule (e.g., a proximal antigen binding domain, e.g., a proximal scFv or scFv1), optionally via a linker, to a transmembrane domain and an intracellular domain, e.g., as described herein. A schematic of a bispecific CAR configuration is depicted in FIG. 27.

In some embodiments, CAR molecule comprises a bispecific CAR comprising a first and second binding specificities. In some embodiments, the bispecific CAR comprises a first binding specificity for a B-cell epitope and a second binding specificity for the same or a different B-cell antigen. For instance, in some embodiments, the bispecific CAR molecule has a first binding specificity for CD20 and a second binding specificity for one or more of CD10, CD19, CD20, CD22, CD34, CD123, FLT-3, ROR1, CD79b, CD179b, or CD79a. In some embodiments the bispecific CAR molecule has a first binding specificity for CD19 and a second binding specificity for CD20. In some embodiments the bispecific CAR molecule has a first binding specificity for CD19 and a second binding specificity for CD22. In some embodiments the bispecific CAR molecule has a first binding specificity for CD22 and a second binding specificity for CD20.

In some embodiments, the CAR molecule comprises a proximal or distal binding specificity for CD19, e.g., a CD19 binding specificity as described herein. In one embodiment, the CAR molecule comprises a proximal binding specificity for CD19, e.g., a CD19 binding specificity as described herein, and a distal binding specificity for CD20, e.g., a CD20 binding specificity as described herein. In one embodiment, the CAR molecule comprises a proximal binding specificity for CD19, e.g., a CD19 binding specificity as described herein, and a distal binding specificity for CD22, e.g., a CD22 binding specificity as described herein. In one embodiment, the CAR molecule comprises a proximal binding specificity for CD20, e.g., a CD20 binding specificity as described herein, and a distal binding specificity for CD19, e.g., a CD19 binding specificity as described herein. In one embodiment, the CAR molecule comprises a proximal binding specificity for CD22, e.g., a CD22 binding specificity as described herein, and a distal binding specificity for CD19, e.g., a CD19 binding specificity as described herein.

In some embodiments, the CAR molecule comprises a proximal or distal binding specificity for CD22, e.g., a CD22 binding specificity as described herein. In one embodiment, the CAR molecule comprises a proximal binding specificity for CD22, e.g., a CD22 binding specificity as described herein, and a distal binding specificity for CD20, e.g., a CD20 binding specificity as described herein. In one embodiment, the CAR molecule comprises a proximal binding specificity for CD20, e.g., a CD20 binding specificity as described herein, and a distal binding specificity for CD22, e.g., a CD22 binding specificity as described herein.

In one embodiment, the CAR molecule comprises a distal to the membrane binding specificity to CD19, e.g., a VL1-VH1 binding specificity to CD19, and a proximal to the membrane binding specificity to CD22, e.g., a VL2-VH2 or VH2-VL1 binding specificity to CD22. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises, e.g., consists of, the amino acid sequence: LAEAAAK (SEQ ID NO: 1091). In one embodiment, the CAR molecule comprises a distal to the membrane binding specificity to CD19, e.g., a VL1-VH1 binding specificity to CD19, optionally, a Gly$_4$-Ser linker (SEQ ID NO: 1090) or a LAEAAAK linker (SEQ ID NO: 1091). In embodiments, the CD22 binding specificity comprises a CD22 VH and VL, wherein the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In one embodiment, the CAR molecule comprises a proximal to the membrane binding specificity to CD19, e.g., a VL1-VH1 binding specificity to CD19, and a distal to the membrane binding specificity to CD22, e.g., a VL2-VH2 or VH2-VL1 binding specificity to CD22. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises, e.g., consists of, the amino acid sequence: LAEAAAK (SEQ ID NO: 1091). In one embodiment, the CAR molecule comprises a proximal to the membrane binding specificity to CD19, e.g., a VL1-VH1 binding specificity to CD19, optionally, a Gly$_4$-Ser linker (SEQ ID NO: 1090) or a LAEAAAK linker (SEQ ID NO: 1091). In embodiments, the CD22 binding specificity comprises a CD22 VH and VL, wherein the linker between the VH and the VL regions is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090), e.g., as in the CD22-65s scFv. In some embodiments, the linker is (Gly$_4$-Ser)$_n$, wherein n=3 (SEQ ID NO: 1084), e.g., as in the CD22-65 scFv. In some embodiments, the linker is (Gly$_4$-Ser)$_n$, wherein n=4 (SEQ ID NO: 23). In some embodiments, the VH and VL regions are connected without a linker, e.g., as in the CD22-65ss scFv.

In some embodiments, the CAR molecule comprises a proximal or distal binding specificity for CD20, e.g., a CD20 binding specificity as described herein.

In one embodiment, the CAR molecule comprises a distal to the membrane binding specificity to CD19, e.g., a VL1-VH1 binding specificity to CD19, and a proximal to the membrane binding specificity to CD20, e.g., a VL2-VH2 or VH2-VL1 binding specificity to CD20. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises, e.g., consists of, the amino acid sequence: LAEAAAK (SEQ ID NO: 1091).

In some embodiments, the CAR molecule comprises a proximal or distal binding specificity for CD20, e.g., a CD20 binding specificity as described herein. In one embodiment, the CAR molecule comprises a proximal to the membrane binding specificity to CD19, e.g., a VL1-VH1 binding specificity to CD19, and a distal to the membrane binding specificity to CD20, e.g., a VL2-VH2 or VH2-VL1 binding specificity to CD20. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises the amino acid sequence: LAEAAAK (SEQ ID NO: 1091). In some embodiments, the linker consists of the amino acid sequence: LAEAAAK (SEQ ID NO: 1091).

In one embodiment, the CAR molecule comprises a distal to the membrane binding specificity to CD22, e.g., a VL1-VH1 binding specificity to CD22, and a proximal to the membrane binding specificity to CD20, e.g., a VL2-VH2 or VH2-VL1 binding specificity to CD20. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises, e.g., consists of, the amino acid sequence: LAEAAAK (SEQ ID NO: 1091).

In some embodiments, the CAR molecule comprises a proximal or distal binding specificity for CD20, e.g., a CD20 binding specificity as described herein. In one embodiment, the CAR molecule comprises a proximal to the membrane binding specificity to CD22, e.g., a VL1-VH1 binding specificity to CD22, and a distal to the membrane binding specificity to CD20, e.g., a VL2-VH2 or VH2-VL1 binding specificity to CD20. In one embodiment, the first and second binding specificity are in a contiguous polypeptide chain, e.g., a single chain. In some embodiments, the first and second binding specificities, optionally, comprise a linker as described herein. In some embodiments, the linker is a (Gly$_4$-Ser)$_n$ linker, wherein n is 1, 2, 3, 4, 5, or 6 (SEQ ID NO: 1089). In some embodiments, the linker is (Gly$_4$-Ser)$_n$, wherein n=1 (SEQ ID NO: 1083), e.g., the linker has the amino acid sequence Gly$_4$-Ser (SEQ ID NO: 1090). In some embodiments, the linker is (Gly$_4$-Ser)$_n$, wherein n=3 (SEQ ID NO: 841). In some embodiments, the linker is (Gly$_4$-Ser)$_n$, wherein n=4 (SEQ ID NO: 23). In some embodiments, the linker comprises the amino acid sequence: LAEAAAK (SEQ ID NO: 1091). In some embodiments, the linker consists of the amino acid sequence: LAEAAAK (SEQ ID NO: 1091)

In some embodiments, the CAR molecule further comprises human sequence leader, e.g., a human CD8alpha sequence at the N-terminus.

Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR, e.g., in one embodiment, the transmembrane domain may be from the same protein that the signaling domain, costimulatory domain or the hinge domain is derived from. In another aspect, the transmembrane domain is not derived from the same protein that any other domain of the CAR is derived from. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect the amino acid sequence of the transmembrane domain may be modified or substituted so as to minimize interactions with the binding domains of the native binding partner present in the same CAR-expressing cell.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD22, CD28, CD3 epsilon, CD45, CD4, CD5, CD8 (e.g., CD8 alpha, CD8 beta), CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, an IgD hinge, a GS linker (e.g., a GS linker described herein), a KIR2DS2 hinge, or a CD8a hinge. In one embodiment, the hinge or spacer comprises (e.g., consists of) the amino acid sequence of SEQ ID NO: 799. In one aspect, the transmembrane domain comprises (e.g., consists of) a transmembrane domain of SEQ ID NO: 801.

In one aspect, the hinge or spacer comprises an IgG4 hinge. For example, in one embodiment, the hinge or spacer comprises a hinge of the amino acid sequence SEQ ID NO: 814. In some embodiments, the hinge or spacer comprises a hinge encoded by a nucleic acid sequence of SEQ ID NO: 815.

In one aspect, the hinge or spacer comprises an IgD hinge. For example, in one embodiment, the hinge or spacer comprises a hinge of the amino acid sequence SEQ ID NO: 816. In some embodiments, the hinge or spacer comprises a hinge encoded by a nucleic acid sequence of (SEQ ID NO: 817).

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGS (SEQ ID NO: 834).

In one aspect, the hinge or spacer comprises a KIR2DS2 hinge.

Cytoplasmic Domain

The cytoplasmic domain or region of the CAR includes an intracellular signaling domain. An intracellular signaling domain is capable of activation of at least one of the normal effector functions of the immune cell in which the CAR has been introduced. The term "effector function" refers to a specialized function of a cell. Effector function of a T cell, for example, may be cytolytic activity or helper activity including the secretion of cytokines. Thus the term "intracellular signaling domain" refers to the portion of a protein which transduces the effector function signal and directs the cell to perform a specialized function. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

Examples of intracellular signaling domains for use in the CAR of the invention include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In one embodiment, a CAR of the invention comprises an intracellular signaling domain, e.g., a primary signaling domain of CD3-zeta.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

Further examples of molecules containing a primary intracellular signaling domain that are of particular use in the invention include those of DAP10, DAP12, and CD32.

The intracellular signalling domain of the CAR can comprise the primary signalling domain, e.g., CD3-zeta signaling domain, by itself or it can be combined with any other desired intracellular signaling domain(s) useful in the context of a CAR of the invention. For example, the intracellular signaling domain of the CAR can comprise a primary signalling domain, e.g., CD3 zeta chain portion, and a costimulatory signaling domain. The costimulatory signaling domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include CD27, CD28, 4-1BB (CD137), OX40, CD30, CD40, PD1, ICOS, lymphocyte function-associated antigen-1 (LFA-1) (CD11a and CD18), CD2, CD7, LIGHT, NKG2C, B7-H3, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). Further examples of such costimulatory molecules include NKp44, NKp30, NKp46, CDS, ICAM-1, GITR, BAFFR, HVEM (LIGHTR), SLAMF7, NKp80 (KLRF1), CD160, CD19, CD4, CD16a, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, and PAG/Cbp.

The intracellular signaling sequences within the cytoplasmic portion of the CAR of the invention may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 803. In one aspect, the signaling domain of CD3-zeta is a signaling domain of SEQ ID NO: 805.

In one aspect, the intracellular signaling domain is designed to comprise the signaling domain of CD3-zeta and the signaling domain of CD27. In one aspect, the signaling domain of CD27 comprises an amino acid sequence of SEQ ID NO: 818. In one aspect, the signalling domain of CD27 is encoded by a nucleic acid sequence of SEQ ID NO: 819.

In one aspect, the CAR-expressing cell described herein can further comprise a second CAR, e.g., a second CAR that includes a different antigen binding domain, e.g., to the same target (CD20) or a different target (e.g., CD22, CD19, ROR1, CD10, CD33, CLL-1, CD34, CD123, FLT3, CD79b, CD179b, and CD79a). In one embodiment, the second CAR includes an antigen binding domain to a target expressed on acute myeloid leukemia cells, such as, e.g., CD22, CD19, ROR1, CD10, CD33, CLL-1, CD34, CD123, FLT3, CD79b, CD179b, and CD79a. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing cell comprises a first CD20 CAR that includes a CD20 binding domain, a transmembrane domain and a costimulatory domain and a second CAR that targets an antigen other than CD20 (e.g., an antigen expressed on AML cells, e.g., CD22, CD19, ROR1, CD10, CD33, CLL-1, CD34, CD123, FLT3, CD79b, CD179b, or CD79a) and includes an antigen binding domain, a transmembrane domain and a primary signaling domain. In another embodiment, the CAR expressing cell comprises a first CD20 CAR that includes a CD20 binding domain, a transmembrane domain and a primary signaling domain and a second CAR that targets an antigen other than CD20 (e.g., an antigen expressed on AML cells, e.g., CD22, CD19, ROR1, CD10, CD33, CD123, CLL-1, CD34, FLT3, CD79b, CD179b, or CD79a) and includes an antigen binding domain to the antigen, a transmembrane domain and a costimulatory signaling domain.

In one embodiment, the CAR-expressing cell comprises a CD20 CAR described herein and an inhibitory CAR. In one embodiment, the inhibitory CAR comprises an antigen binding domain that binds an antigen found on normal cells but not cancer cells, e.g., normal cells that also express CD20. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta.

In one embodiment, when the CAR-expressing cell comprises two or more different CARs, the antigen binding domains of the different CARs can be such that the antigen binding domains do not interact with one another. For example, a cell expressing a first and second CAR can have an antigen binding domain of the first CAR, e.g., as a fragment, e.g., an scFv, that does not form an association with the antigen binding domain of the second CAR, e.g., the antigen binding domain of the second CAR is a VHH.

In some embodiments, the antigen binding domain comprises a single domain antigen binding (SDAB) molecules include molecules whose complementarity determining regions are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies. SDAB molecules may be any of the art, or any future single domain molecules. SDAB molecules may be derived from any species including, but not limited to mouse, human, camel, llama, lamprey, fish, shark, goat, rabbit, and bovine. This term also includes naturally occurring single domain antibody molecules from species other than Camelidae and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

According to another aspect, an SDAB molecule is a naturally occurring single domain antigen binding molecule known as heavy chain devoid of light chains. Such single domain molecules are disclosed in WO 9404678 and Hamers-Casterman, C. et al. (1993) Nature 363:446-448, for example. For clarity reasons, this variable domain derived from a heavy chain molecule naturally devoid of light chain is known herein as a VHH or nanobody to distinguish it from the conventional VH of four chain immunoglobulins. Such a VHH molecule can be derived from Camelidae species, for example in camel, llama, dromedary, alpaca and guanaco. Other species besides Camelidae may produce heavy chain molecules naturally devoid of light chain; such VHHs are within the scope of the invention.

The SDAB molecules can be recombinant, CDR-grafted, humanized, camelized, de-immunized and/or in vitro generated (e.g., selected by phage display).

It has also been discovered, that cells having a plurality of chimeric membrane embedded receptors comprising an antigen binding domain that interactions between the antigen binding domain of the receptors can be undesirable, e.g., because it inhibits the ability of one or more of the antigen binding domains to bind its cognate antigen. Accordingly, disclosed herein are cells having a first and a second non-naturally occurring chimeric membrane embedded receptor comprising antigen binding domains that minimize such interactions. Also disclosed herein are nucleic acids encoding a first and a second non-naturally occurring chimeric membrane embedded receptor comprising a antigen binding domains that minimize such interactions, as well as methods of making and using such cells and nucleic acids. In an embodiment the antigen binding domain of one of said first said second non-naturally occurring chimeric membrane embedded receptor, comprises an scFv, and the other comprises a single VH domain, e.g., a camelid, shark, or lamprey single VH domain, or a single VH domain derived from a human or mouse sequence.

In some embodiments, the claimed invention comprises a first and second CAR, wherein the antigen binding domain of one of said first CAR said second CAR does not comprise a variable light domain and a variable heavy domain. In some embodiments, the antigen binding domain of one of said first CAR said second CAR is an scFv, and the other is not an scFv. In some embodiments, the antigen binding domain of one of said first CAR said second CAR comprises a single VH domain, e.g., a camelid, shark, or lamprey single VH domain, or a single VH domain derived from a human or mouse sequence. In some embodiments, the antigen binding domain of one of said first CAR said second CAR comprises a nanobody. In some embodiments, the antigen binding domain of one of said first CAR said second CAR comprises a camelid VHH domain.

In some embodiments, the antigen binding domain of one of said first CAR said second CAR comprises an scFv, and the other comprises a single VH domain, e.g., a camelid, shark, or lamprey single VH domain, or a single VH domain derived from a human or mouse sequence. In some embodiments, the antigen binding domain of one of said first CAR said second CAR comprises an scFv, and the other comprises a nanobody. In some embodiments, the antigen binding domain of one of said first CAR said second CAR comprises an scFv, and the other comprises a camelid VHH domain.

In some embodiments, when present on the surface of a cell, binding of the antigen binding domain of said first CAR to its cognate antigen is not substantially reduced by the presence of said second CAR. In some embodiments, binding of the antigen binding domain of said first CAR to its cognate antigen in the presence of said second CAR is 85%, 90%, 95%, 96%, 97%, 98% or 99% of binding of the antigen binding domain of said first CAR to its cognate antigen in the absence of said second CAR.

In some embodiments, when present on the surface of a cell, the antigen binding domains of said first CAR said second CAR, associate with one another less than if both were scFv antigen binding domains. In some embodiments, the antigen binding domains of said first CAR said second CAR, associate with one another 85%, 90%, 95%, 96%, 97%, 98% or 99% less than if both were scFv antigen binding domains.

In another aspect, the CAR-expressing cell described herein can further express another agent, e.g., an agent which enhances the activity of a CAR-expressing cell. For example, in one embodiment, the agent can be an agent which inhibits an inhibitory molecule. Inhibitory molecules, e.g., PD1, can, in some embodiments, decrease the ability of a CAR-expressing cell to mount an immune effector response. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGF beta. In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta, or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of an extracellular domain of PD1), and a second polypeptide of an intracellular signaling domain described herein (e.g., a CD28 signaling domain described herein and/or a CD3 zeta signaling domain described herein). PD1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L1.

In one embodiment, the agent comprises the extracellular domain (ECD) of an inhibitory molecule, e.g., Programmed Death 1 (PD1), can be fused to a transmembrane domain and intracellular signaling domains such as 41BB and CD3 zeta (also referred to herein as a PD1 CAR). In one embodiment, the PD1 CAR, when used in combinations with a CD20 CAR described herein, improves the persistence of the T cell. In one embodiment, the CAR is a PD1 CAR comprising the extracellular domain of PD1 according to SEQ ID NO: 820. In one embodiment, the PD1 CAR comprises the amino acid sequence of SEQ ID NO: 820.

In one embodiment, the agent comprises a nucleic acid sequence encoding the PD1 CAR, e.g., the PD1 CAR described herein. In one embodiment, the nucleic acid sequence for the PD1 CAR is SEQ ID NO: 821.

In another aspect, the present invention provides a population of CAR-expressing cells, e.g., CART cells or CAR-expressing NK cells. In some embodiments, the population of CAR-expressing cells comprises a mixture of cells expressing different CARs. For example, in one embodiment, the population of CAR-expressing cells can include a first cell expressing a CAR having a CD20 binding domain described herein, and a second cell expressing a CAR having a different CD20 binding domain, e.g., a CD20 binding domain described herein that differs from the CD20 binding domain in the CAR expressed by the first cell. As another example, the population of CAR-expressing cells can include a first cell expressing a CAR that includes a CD20 binding domain, e.g., as described herein, and a second cell expressing a CAR that includes an antigen binding domain to a target other than CD20 (e.g., CD22, CD19, ROR1, CD10, CD33, CD34, CLL-1, CD123, FLT3, CD79b, CD179b, or CD79a). In one embodiment, the population of CAR-expressing cells includes, e.g., a first cell expressing a CAR that includes a primary intracellular signaling domain, and a second cell expressing a CAR that includes a secondary signaling domain, e.g., a costimulatory signaling domain.

In another aspect, the present invention provides a population of cells wherein at least one cell in the population expresses a CAR having a CD20 binding domain described herein, and a second cell expressing another agent, e.g., an agent which enhances the activity of a CAR-expressing cell. For example, in one embodiment, the agent can be an agent which inhibits an inhibitory molecule. Inhibitory molecules, e.g., can, in some embodiments, decrease the ability of a CAR-expressing cell to mount an immune effector response. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGF beta. In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta, or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In one aspect, the present invention provides methods comprising administering a population of CAR-expressing cells, e.g., CAR-expressing cells, e.g., a mixture of cells expressing different CARs, in combination with another agent, e.g., a kinase inhibitor, such as a kinase inhibitor described herein. In another aspect, the present invention provides methods comprising administering a population of cells wherein at least one cell in the population expresses a CAR having an anti-cancer associated antigen binding domain as described herein, and a second cell expressing another agent, e.g., an agent which enhances the activity of a CAR-expressing cell, in combination with another agent, e.g., a kinase inhibitor, such as a kinase inhibitor described herein.

Regulatable Chimeric Antigen Receptors

In some embodiments, a regulatable CAR (RCAR) where the CAR activity can be controlled is desirable to optimize the safety and efficacy of a CAR therapy. There are many ways CAR activities can be regulated. For example, inducible apoptosis using, e.g., a caspase fused to a dimerization domain (see, e.g., Di Stasa et al., N Egnl. J. Med. 2011 Nov. 3; 365(18):1673-1683), can be used as a safety switch in the CAR therapy of the instant invention. In one embodiment, the cells (e.g., T cells or NK cells) expressing a CAR of the present invention further comprise an inducible apoptosis switch, wherein a human caspase (e.g., caspase 9) or a modified version is fused to a modification of the human FKB protein that allows conditional dimerization. In the presence of a small molecule, such as a rapalog (e.g., AP 1903, AP20187), the inducible caspase (e.g., caspase 9) is activated and leads to the rapid apoptosis and death of the cells (e.g., T cells or NK cells) expressing a CAR of the present invention. Examples of a caspase-based inducible apoptosis switch (or one or more aspects of such a switch) have been described in, e.g., US2004040047; US20110286980; US20140255360; WO1997031899; WO2014151960; WO2014164348; WO2014197638; WO2014197638; all of which are incorporated by reference herein.

In an aspect, a RCAR comprises a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain. In one embodiment, a CAR of the present invention utilizes a dimerization switch as those described in, e.g., WO2014127261, which is incorporated by reference herein.

In an aspect, an RCAR comprises two polypeptides or members: 1) an intracellular signaling member comprising an intracellular signaling domain, e.g., a primary intracellular signaling domain described herein, and a first switch domain; 2) an antigen binding member comprising an antigen binding domain, e.g., that targets CD19, as described herein and a second switch domain. Optionally, the RCAR comprises a transmembrane domain described herein. In an embodiment, a transmembrane domain can be disposed on the intracellular signaling member, on the antigen binding member, or on both. (Unless otherwise indicated, when members or elements of an RCAR are described herein, the order can be as provided, but other orders are included as well. In other words, in an embodiment, the order is as set out in the text, but in some embodiments, the order can be different. E.g., the order of elements on one side of a transmembrane region can be different from the example, e.g., the placement of a switch domain relative to a intracellular signaling domain can be different, e.g., reversed).

In an embodiment, the first and second switch domains can form an intracellular or an extracellular dimerization switch. In an embodiment, the dimerization switch can be a homodimerization switch, e.g., where the first and second switch domain are the same, or a heterodimerization switch, e.g., where the first and second switch domain are different from one another.

In embodiments, an RCAR can comprise a "multi switch." A multi switch can comprise heterodimerization switch domains or homodimerization switch domains. A multi switch comprises a plurality of, e.g., 2, 3, 4, 5, 6, 7, 8, 9, or 10, switch domains, independently, on a first member, e.g., an antigen binding member, and a second member, e.g., an intracellular signaling member. In an embodiment, the first member can comprise a plurality of first switch domains, e.g., FKBP-based switch domains, and the second member can comprise a plurality of second switch domains, e.g., FRB-based switch domains. In an embodiment, the first member can comprise a first and a second switch domain, e.g., a FKBP-based switch domain and a FRB-based switch domain, and the second member can comprise a first and a second switch domain, e.g., a FKBP-based switch domain and a FRB-based switch domain.

In an embodiment, the intracellular signaling member comprises one or more intracellular signaling domains, e.g., a primary intracellular signaling domain and one or more costimulatory signaling domains.

In an embodiment, the antigen binding member may comprise one or more intracellular signaling domains, e.g., one or more costimulatory signaling domains. In an embodiment, the antigen binding member comprises a plurality, e.g., 2 or 3 costimulatory signaling domains described herein, e.g., selected from 41BB, CD28, CD27, ICOS, and OX40, and in embodiments, no primary intracellular signaling domain. In an embodiment, the antigen binding member comprises the following costimulatory signaling domains, from the extracellular to intracellular direction: 41BB-CD27; 41BB-CD27; CD27-41BB; 41BB-CD28; CD28-41BB; OX40-CD28; CD28-OX40; CD28-41BB; or 41BB-CD28. In such embodiments, the intracellular binding member comprises a CD3zeta domain. In one such embodiment the RCAR comprises (1) an antigen binding member comprising, an antigen binding domain, a transmembrane domain, and two costimulatory domains and a first switch domain; and (2) an intracellular signaling domain comprising a transmembrane domain or membrane tethering domain and at least one primary intracellular signaling domain, and a second switch domain.

An embodiment provides RCARs wherein the antigen binding member is not tethered to the surface of the CAR cell. This allows a cell having an intracellular signaling member to be conveniently paired with one or more antigen binding domains, without transforming the cell with a sequence that encodes the antigen binding member. In such embodiments, the RCAR comprises: 1) an intracellular signaling member comprising: a first switch domain, a transmembrane domain, an intracellular signaling domain, e.g., a primary intracellular signaling domain, and a first switch domain; and 2) an antigen binding member comprising: an antigen binding domain, and a second switch domain, wherein the antigen binding member does not comprise a transmembrane domain or membrane tethering domain, and, optionally, does not comprise an intracellular signaling domain. In some embodiments, the RCAR may further comprise 3) a second antigen binding member comprising: a second antigen binding domain, e.g., a second antigen binding domain that binds a different antigen than is bound by the antigen binding domain; and a second switch domain.

Also provided herein are RCARs wherein the antigen binding member comprises bispecific activation and targeting capacity. In this embodiment, the antigen binding member can comprise a plurality, e.g., 2, 3, 4, or 5 antigen binding domains, e.g., scFvs, wherein each antigen binding domain binds to a target antigen, e.g. different antigens or the same antigen, e.g., the same or different epitopes on the same antigen. In an embodiment, the plurality of antigen binding domains are in tandem, and optionally, a linker or hinge region is disposed between each of the antigen binding domains. Suitable linkers and hinge regions are described herein.

An embodiment provides RCARs having a configuration that allows switching of proliferation. In this embodiment, the RCAR comprises: 1) an intracellular signaling member comprising: optionally, a transmembrane domain or membrane tethering domain; one or more co-stimulatory signaling domain, e.g., selected from 41BB, CD28, CD27, ICOS, and OX40, and a switch domain; and 2) an antigen binding member comprising: an antigen binding domain, a transmembrane domain, and a primary intracellular signaling domain, e.g., a CD3zeta domain, wherein the antigen binding member does not comprise a switch domain, or does not comprise a switch domain that dimerizes with a switch domain on the intracellular signaling member. In an embodiment, the antigen binding member does not comprise a co-stimulatory signaling domain. In an embodiment, the intracellular signaling member comprises a switch domain from a homodimerization switch. In an embodiment, the intracellular signaling member comprises a first switch domain of a heterodimerization switch and the RCAR comprises a second intracellular signaling member which comprises a second switch domain of the heterodimerization switch. In such embodiments, the second intracellular signaling member comprises the same intracellular signaling domains as the intracellular signaling member. In an embodiment, the dimerization switch is intracellular. In an embodiment, the dimerization switch is extracellular.

In any of the RCAR configurations described here, the first and second switch domains comprise a FKBP-FRB based switch as described herein.

Also provided herein are cells comprising an RCAR described herein. Any cell that is engineered to express a RCAR can be used as a RCARX cell. In an embodiment the RCARX cell is a T cell, and is referred to as a RCART cell. In an embodiment the RCARX cell is an NK cell, and is referred to as a RCARN cell.

Also provided herein are nucleic acids and vectors comprising RCAR encoding sequences. Sequence encoding various elements of an RCAR can be disposed on the same nucleic acid molecule, e.g., the same plasmid or vector, e.g., viral vector, e.g., lentiviral vector. In an embodiment, (i) sequence encoding an antigen binding member and (ii) sequence encoding an intracellular signaling member, can be present on the same nucleic acid, e.g., vector. Production of the corresponding proteins can be achieved, e.g., by the use of separate promoters, or by the use of a bicistronic transcription product (which can result in the production of two proteins by cleavage of a single translation product or by the translation of two separate protein products). In an embodiment, a sequence encoding a cleavable peptide, e.g., a P2A or F2A sequence, is disposed between (i) and (ii). In an embodiment, a sequence encoding an IRES, e.g., an EMCV or EV71 IRES, is disposed between (i) and (ii). In these embodiments, (i) and (ii) are transcribed as a single RNA. In an embodiment, a first promoter is operably linked to (i) and a second promoter is operably linked to (ii), such that (i) and (ii) are transcribed as separate mRNAs.

Alternatively, the sequence encoding various elements of an RCAR can be disposed on the different nucleic acid molecules, e.g., different plasmids or vectors, e.g., viral vector, e.g., lentiviral vector. E.g., the (i) sequence encoding an antigen binding member can be present on a first nucleic acid, e.g., a first vector, and the (ii) sequence encoding an intracellular signaling member can be present on the second nucleic acid, e.g., the second vector.

Dimerization Switches

Dimerization switches can be non-covalent or covalent. In a non-covalent dimerization switch, the dimerization molecule promotes a non-covalent interaction between the switch domains. In a covalent dimerization switch, the dimerization molecule promotes a covalent interaction between the switch domains.

In an embodiment, the RCAR comprises a FKBP/FRAP, or FKBP/FRB,-based dimerization switch. FKBP12 (FKBP, or FK506 binding protein) is an abundant cytoplasmic protein that serves as the initial intracellular target for the natural product immunosuppressive drug, rapamycin. Rapamycin binds to FKBP and to the large PI3K homolog FRAP (RAFT, mTOR). FRB is a 93 amino acid portion of FRAP, that is sufficient for binding the FKBP-rapamycin complex (Chen, J., Zheng, X. F., Brown, E. J. & Schreiber, S. L. (1995) *Identification of an 11-kDa FKBP12-rapamycin-binding domain within the 289-kDa FKBP12-rapamycin-associated protein and characterization of a critical serine residue*. Proc Natl Acad Sci USA 92: 4947-51.)

In embodiments, an FKBP/FRAP, e.g., an FKBP/FRB, based switch can use a dimerization molecule, e.g., rapamycin or a rapamycin analog.

The amino acid sequence of FKBP is SEQ ID NO: 824.

In embodiments, an FKBP switch domain can comprise a fragment of FKBP having the ability to bind with FRB (SEQ ID NO: 825), or a fragment or analog thereof, in the presence of rapamycin or a rapalog.

The amino acid sequence of FRB is SEQ ID NO: 826.

"FKBP/FRAP, e.g., an FKBP/FRB, based switch" as that term is used herein, refers to a dimerization switch comprising: a first switch domain, which comprises an FKBP fragment or analog thereof having the ability to bind with FRB, or a fragment or analog thereof, in the presence of rapamycin or a rapalog, e.g., RAD001, and has at least 70, 75, 80, 85, 90, 95, 96, 97, 98, or 99% identity with, or differs by no more than 30, 25, 20, 15, 10, 5, 4, 3, 2, or 1 amino acid residues from, the FKBP sequence of SEQ ID NO: 824 or 825; and a second switch domain, which comprises an FRB fragment or analog thereof having the ability to bind with FRB, or a fragment or analog thereof, in the presence of rapamycin or a rapalog, and has at least 70, 75, 80, 85, 90, 95, 96, 97, 98, or 99% identity with, or differs by no more than 30, 25, 20, 15, 10, 5, 4, 3, 2, or 1 amino acid residues from, the FRB sequence of SEQ ID NO: 826. In an embodiment, a RCAR described herein comprises one switch domain comprises amino acid residues disclosed in SEQ ID NO: 824 or 825, and one switch domain comprises amino acid residues disclosed in SEQ ID NO: 826.

In embodiments, the FKBP/FRB dimerization switch comprises a modified FRB switch domain that exhibits altered, e.g., enhanced, complex formation between an FRB-based switch domain, e.g., the modified FRB switch domain, a FKBP-based switch domain, and the dimerization molecule, e.g., rapamycin or a rapalogue, e.g., RAD001. In an embodiment, the modified FRB switch domain comprises one or more mutations, e.g., 2, 3, 4, 5, 6, 7, 8, 9, 10 or more, selected from mutations at amino acid position(s) L2031, E2032, S2035, R2036, F2039, G2040, T2098, W2101, D2102, Y2105, and F2108, where the wild-type amino acid is mutated to any other naturally-occurring amino acid. In an embodiment, a mutant FRB comprises a mutation at E2032, where E2032 is mutated to phenylalanine (E2032F), methionine (E2032M), arginine (E2032R), valine (E2032V), tyrosine (E2032Y), isoleucine (E2032I), e.g., SEQ ID NO: 827, or leucine (E2032L), e.g., SEQ ID NO: 828. In an embodiment, a mutant FRB comprises a mutation at T2098, where T2098 is mutated to phenylalanine (T2098F) or leucine (T2098L), e.g., SEQ ID NO: 829. In an embodiment, a mutant FRB comprises a mutation at E2032 and at T2098, where E2032 is mutated to any amino acid, and where T2098 is mutated to any amino acid, e.g., SEQ ID NO: 830. In an embodiment, a mutant FRB comprises an E2032I and a T2098L mutation, e.g., SEQ ID NO: 831. In an embodiment, a mutant FRB comprises an E2032L and a T2098L mutation, e.g., SEQ ID NO: 832.

Other suitable dimerization switches include a GyrB-GyrB based dimerization switch, a Gibberellin-based dimerization switch, a tag/binder dimerization switch, and a halo-tag/snap-tag dimerization switch. Following the guidance provided herein, such switches and relevant dimerization molecules will be apparent to one of ordinary skill.

Dimerization Molecule

Association between the switch domains is promoted by the dimerization molecule. In the presence of dimerization molecule interaction or association between switch domains allows for signal transduction between a polypeptide associated with, e.g., fused to, a first switch domain, and a polypeptide associated with, e.g., fused to, a second switch domain. In the presence of non-limiting levels of dimerization molecule signal transduction is increased by 1.1, 1.2, 1.3, 1.4, 1.5, 1.6, 1.7, 1.8, 1.9, 2, 5, 10, 50, 100 fold, e.g., as measured in a system described herein.

Rapamycin and rapamycin analogs (sometimes referred to as rapalogues), e.g., RAD001, can be used as dimerization molecules in a FKBP/FRB-based dimerization switch described herein. In an embodiment the dimerization molecule can be selected from rapamycin (sirolimus), RAD001 (everolimus), zotarolimus, temsirolimus, AP-23573 (ridaforolimus), biolimus and AP21967. Additional rapamycin analogs suitable for use with FKBP/FRB-based dimerization switches are further described in the section entitled "Combination Therapies", or in the subsection entitled "Exemplary mTOR inhibitors".

Split CAR

In some embodiments, the CAR-expressing cell uses a split CAR. The split CAR approach is described in more detail in PCT publications WO2014/055442 and WO2014/055657, incorporated herein by reference. Briefly, a split CAR system comprises a cell expressing a first CAR having a first antigen binding domain and a costimulatory domain (e.g., 4-1BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens.

RNA Transfection

Disclosed herein are methods for producing an in vitro transcribed RNA CAR. The present invention also includes a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO: 1093). RNA so produced can efficiently transfect different kinds of cells. In one aspect, the template includes sequences for the CAR.

In one aspect the CD20 CAR is encoded by a messenger RNA (mRNA). In one aspect the mRNA encoding the CD20 CAR is introduced into an immune effector cell, e.g., a T cell or a NK cell, for production of a CAR-expressing cell, e.g., a CART cell or a CAR NK cell.

In one embodiment, the in vitro transcribed RNA CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired temple for in vitro transcription is a CAR of the present invention. For example, the template for the RNA CAR comprises an extracellular region comprising a single chain variable domain of an anti-tumor antibody; a hinge region, a transmembrane domain (e.g., a transmembrane domain of CD8a); and a cytoplasmic region that includes an intracellular signaling domain, e.g., comprising the signaling domain of CD3-zeta and the signaling domain of 4-1BB.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementarity to regions of the DNA to be used as a template for the PCR. "Substantially complementarity," as used herein, refers to sequences of nucleotides where a majority or all of the bases in the primer sequence are complementarity, or one or more bases are non-complementarity, or mismatched. Substantially complementarity sequences are able to anneal or hybridize with the intended DNA target under annealing conditions used for PCR. The primers can be designed to be substantially complementarity to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementarity to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementarity to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In some embodiments, the 5' UTR can be 5'UTR of an RNA virus whose RNA genome is stable in cells. In some embodiments, various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleic acid sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100 T tail (SEQ ID NO: 1094) (size can be 50-5000 T (SEQ ID NO: 1095)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (SEQ ID NO: 1096).

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1 (2011):R14-20; Singh et al. Cancer Res. 15 (2008):2961-2971; Huang et al. Mol. Ther. 16 (2008):580-589; Grabundzija et al. Mol. Ther. 18 (2010):1200-1209; Kebriaei et al. Blood. 122.21 (2013): 166; Williams. Molecular Therapy 16.9 (2008):1515-16; Bell et al. Nat. Protoc. 2.12 (2007):3153-65; and Ding et al. Cell. 122.3 (2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al.

Exemplary transposons include a pT2-based transposon. See, e.g., Grabundzija et al. Nucleic Acids Res. 41.3 (2013): 1829-47; and Singh et al. Cancer Res. 68.8 (2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In some embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Nucleic Acid Constructs Encoding a CAR

The present invention also provides nucleic acid molecules encoding one or more CAR constructs described herein. In one aspect, the nucleic acid molecule is provided as a messenger RNA transcript. In one aspect, the nucleic acid molecule is provided as a DNA construct.

Accordingly, in one aspect, the invention pertains to an isolated nucleic acid molecule encoding a chimeric antigen receptor (CAR), wherein the CAR comprises a CD20 binding domain (e.g., a murine, humanized or human CD20 binding domain), a transmembrane domain, and an intracellular signaling domain comprising a stimulatory domain, e.g., a costimulatory signaling domain and/or a primary signaling domain, e.g., zeta chain. In one embodiment, the CD20 binding domain is a CD20 binding domain described herein, e.g., a CD20 binding domain which comprises a sequence selected from a group consisting of SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429, or a sequence with 95-99% identity thereof. In one embodiment, the transmembrane domain is transmembrane domain of a protein, e.g., described herein, e.g., selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD123, CD134, CD137 and CD154. In one embodiment, the transmembrane domain comprises a sequence of SEQ ID NO: 801, or a sequence with 95-99% identity thereof. In one embodiment, the CD20 binding domain is connected to the transmembrane domain by a hinge region, e.g., a hinge described herein. In one embodiment, the hinge region comprises SEQ ID NO: 799 or SEQ ID NO: 814 or SEQ ID NO: 816, or a sequence with 95-99% identity thereof. In one embodiment, the isolated nucleic acid molecule further comprises a sequence encoding a costimulatory domain. In one embodiment, the costimulatory domain is a functional signaling domain of a protein, e.g., described herein, e.g., selected from the group consisting of OX40, CD27, CD28, CDS, ICAM-1, LFA-1 (CD11a/CD18), ICOS (CD278), and 4-1BB (CD137). In one embodiment, the costimulatory domain comprises a sequence of SEQ ID NO: 803, or a sequence with 95-99% identity thereof. In one embodiment, the intracellular signaling domain comprises a functional signaling domain of 4-1BB and a functional signaling domain of CD3 zeta. In one embodiment, the intracellular signaling domain comprises the sequence of SEQ ID NO: 805 or SEQ ID NO: 806, or a sequence with 95-99% identity thereof, and the sequence of SEQ ID NO: 807 or SEQ ID NO: 808, or a sequence with 95-99% identity thereof, wherein the sequences comprising the intracellular signaling domain are expressed in the same frame and as a single polypeptide chain.

In another aspect, the invention pertains to an isolated nucleic acid molecule encoding a CAR construct comprising a leader sequence of SEQ ID NO: 797, a scFv domain having a sequence selected from the group consisting of SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429 (or a sequence with 95-99% identity thereof), a hinge region of SEQ ID NO: 799 or SEQ ID NO: 814 or SEQ ID NO: 814 (or a sequence with 95-99% identity thereof), a transmembrane domain having a sequence of SEQ ID NO: 801 (or a sequence with 95-99% identity thereof), a 4-1BB costimulatory domain having a sequence of SEQ ID NO: 803 or a CD27 costimulatory domain having a sequence of SEQ ID NO: 818 (or a sequence with 95-99% identity thereof), and a CD3 zeta stimulatory domain having a sequence of SEQ ID NO: 805 or SEQ ID NO: 807 (or a sequence with 95-99% identity thereof).

In another aspect, the invention pertains to an isolated polypeptide molecule encoded by the nucleic acid molecule. In one embodiment, the isolated polypeptide molecule comprises a sequence selected from the group consisting of SEQ ID NO: 25, SEQ ID NO: 52, SEQ ID NO: 79, SEQ ID NO: 106, SEQ ID NO: 133, SEQ ID NO: 160, SEQ ID NO: 187, SEQ ID NO: 214, SEQ ID NO: 241, SEQ ID NO: 268, SEQ ID NO: 295, SEQ ID NO: 322, SEQ ID NO: 349, SEQ ID NO: 376, SEQ ID NO: 403, and SEQ ID NO: 430, or a sequence with 95-99% identity thereof.

In another aspect, the invention pertains to a nucleic acid molecule encoding a chimeric antigen receptor (CAR) molecule that comprises a CD20 binding domain, a transmembrane domain, and an intracellular signaling domain comprising a stimulatory domain, and wherein said CD20 binding domain comprises a sequence selected from the group consisting of SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429, or a sequence with 95-99% identity thereof.

In one embodiment, the encoded CAR molecule further comprises a sequence encoding a costimulatory domain. In one embodiment, the costimulatory domain is a functional signaling domain of a protein selected from the group consisting of OX40, CD27, CD28, CDS, ICAM-1, LFA-1 (CD11a/CD18) and 4-1BB (CD137). In one embodiment, the costimulatory domain comprises a sequence of SEQ ID NO: 803. In one embodiment, the transmembrane domain is a transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD123, CD134, CD137, CD154, KIR2DS2, OX40, CD2, CD27, LFA-1 (CD11a and CD18), ICOS (CD278), 4-1BB (CD137), GITR, CD40, BAFFR, HVEM (LIGHTR), SLAMF7, NKp80 (KLRF1), CD160, CD19, IL2R β, IL2R g (Common gamma), IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4, (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR and PAG/Cbp.

In one embodiment, the transmembrane domain comprises a sequence of SEQ ID NO: 803. In one embodiment, the intracellular signaling domain comprises a functional signaling domain of 4-1BB and a functional signaling domain of zeta. In one embodiment, the intracellular signaling domain comprises the sequence of SEQ ID NO: 803 and the sequence of SEQ ID NO: 804, wherein the sequences comprising the intracellular signaling domain are expressed in the same frame and as a single polypeptide chain. In one embodiment, the CD20 binding domain is connected to the transmembrane domain by a hinge region. In one embodiment, the hinge region comprises SEQ ID NO: 799. In one embodiment, the hinge region comprises SEQ ID NO: 799 or SEQ ID NO: 814 or SEQ ID NO: 816.

In another aspect, the invention pertains to an encoded CAR molecule comprising a leader sequence of SEQ ID NO: 797, a scFv domain having a sequence selected from the group consisting of SEQ ID NO: 24, SEQ ID NO: 51, SEQ ID NO: 78, SEQ ID NO: 105, SEQ ID NO: 132, SEQ ID NO: 159, SEQ ID NO: 186, SEQ ID NO: 213, SEQ ID NO: 240, SEQ ID NO: 267, SEQ ID NO: 294, SEQ ID NO: 321, SEQ ID NO: 348, SEQ ID NO: 375, SEQ ID NO: 402, and SEQ ID NO: 429, or a sequence with 95-99% identity thereof, a hinge region of SEQ ID NO: 799 or SEQ ID NO: 814 or SEQ ID NO: 816, a transmembrane domain having a sequence of SEQ ID NO: 801, a 4-1BB costimulatory domain having a sequence of SEQ ID NO: 803 or a CD27 costimulatory domain having a sequence of SEQ ID NO: 818, and a CD3 zeta stimulatory domain having a sequence of SEQ ID NO: 805 or SEQ ID NO: 807.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, crisper, CAS9, and zinc finger nucleases. See below June et al. 2009 *Nature Reviews Immunology* 9.10: 704-716, is incorporated herein by reference.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription. Exemplary promoters include the CMV IE gene, EF-1α, ubiquitin C, or phosphoglycerokinase (PGK) promoters.

An example of a promoter that is capable of expressing a CAR transgene in a mammalian T cell is the EF-1 alpha (EF1a) promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from transgenes cloned into a lentiviral vector. See, e.g., Milone et al., Mol. Ther. 17(8): 1453-1464 (2009). In one aspect, the EF1a promoter comprises the sequence provided as SEQ ID NO: 833.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In one embodiment, the vector can further comprise a nucleic acid encoding a second CAR. In one embodiment, the second CAR includes an antigen binding domain to a target expressed on acute myeloid leukemia cells, such as, e.g., CD22, CD19, ROR1, CD10, CD33, CD34, CLL-1, CD123, FLT3, CD79b, CD179b, or CD79a. In one embodiment, the vector comprises a nucleic acid sequence encoding a first CAR that targets a first antigen and includes an intracellular signaling domain having a costimulatory signaling domain but not a primary signaling domain, and a nucleic acid encoding a second CAR that targets a second, different, antigen and includes an intracellular signaling domain having a primary signaling domain but not a costimulatory signaling domain. In one embodiment, the vector comprises a nucleic acid encoding a first CD20 CAR that includes a CD20 binding domain, a transmembrane domain and a costimulatory domain and a nucleic acid encoding a second CAR that targets an antigen other than CD20 (e.g., an antigen expressed on AML cells, e.g., CD22, CD19, ROR1, CD10, CD33, CD34, CLL-1, CD123, FLT3, CD79b, CD179b, or CD79a) and includes an antigen binding domain, a transmembrane domain and a primary signaling domain. In another embodiment, the vector comprises a nucleic acid encoding a first CD20 CAR that includes a CD20 binding domain, a transmembrane domain and a primary signaling domain and a nucleic acid encoding a second CAR that targets an antigen other than CD20 (e.g., an antigen expressed on AML cells, e.g., CD22, CD19, ROR1, CD10, CD33, CLL-1, CD34, CD123, FLT3, CD79b, CD179b, or CD79a) and includes an antigen binding domain to the antigen, a transmembrane domain and a costimulatory signaling domain.

In one embodiment, the vector comprises a nucleic acid encoding a CD20 CAR described herein and a nucleic acid encoding an inhibitory CAR. In one embodiment, the inhibitory CAR comprises an antigen binding domain that binds an antigen found on normal cells but not cancer cells, e.g., normal cells that also express CD20. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A preferred method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

The present invention further provides a vector comprising a CAR encoding nucleic acid molecule. In one aspect, a CAR vector can be directly transduced into a cell, e.g., a T cell or NK cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the CAR construct in mammalian T cells or NK cells. In one aspect, the mammalian T cell is a human T cell.

Sources of Cells

Prior to expansion and genetic modification or other modification, a source of cells, e.g., T cells or natural killer (NK) cells, can be obtained from a subject. The term "subject" is intended to include living organisms in which an immune response can be elicited (e.g., mammals). Examples of subjects include humans, monkeys, chimpanzees, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors. In certain aspects of the present invention disclosure, immune effector cells, e.g., T cells, can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one aspect of the invention, the cells are washed with phosphate buffered saline (PBS). In an alternative aspect, the wash solution lacks calcium and may lack magnesium or may lack many if not all divalent cations. Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

In one aspect, T cells are isolated from peripheral blood lymphocytes by lysing the red blood cells and depleting the monocytes, for example, by centrifugation through a PERCOLL™ gradient or by counterflow centrifugal elutriation.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-C25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Militenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-C25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In some embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include B7-H1, B&-1, CD160, P1H, 2B4, PD1, TIM3, CEACAM (e.g., CEACAM-1, CEACAM-3 and/or CEACAM-5), LAG3, TIGIT, CTLA-4, BTLA and LAIR1. In one embodiment, check point inhibitor expressing cells are removed simultaneously with the T regulatory, e.g., CD25+ cells. For example, an anti-C25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In some embodiments, the removal of T regulatory cells, e.g., CD25+ cells, and the removal of the check point inhibitor expressing cells is sequential, and can occur, e.g., in either order.

Methods described herein can include a positive selection step. For example, T cells can be isolated by incubation with anti-CD3/anti-CD28 (e.g., 3×28)-conjugated beads, such as DYNABEADS® M-450 CD3/CD28 T, for a time period sufficient for positive selection of the desired T cells. In one aspect, the time period is about 30 minutes. In a further aspect, the time period ranges from 30 minutes to 36 hours or longer and all integer values there between. In a further aspect, the time period is at least 1, 2, 3, 4, 5, or 6 hours. In yet another preferred aspect, the time period is 10 to 24 hours. In one aspect, the incubation time period is 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of about 10 billion cells/ml, 9 billion/ml, 8 billion/ml, 7 billion/ml, 6 billion/ml, or 5 billion/ml is used. In one aspect, a concentration of 1 billion cells/ml is used. In one aspect, a concentration of cells from 75, 80, 85, 90, 95, or 100 million cells/ml is used. In further aspects, concentrations of 125 or 150 million cells/ml can be used.

Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is 5×10e6/ml. In other aspects, the concentration used can be from about $1\times10^5$/ml to $1\times10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 10 per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in immune effector cell therapy for any number of diseases or conditions that would benefit from immune effector cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells or NK cells, to be engineered to express a CAR, are harvested after a sufficient time, or after sufficient dosing of the low, immune enhancing, dose of an mTOR inhibitor, such that the level of PD1 negative immune effector cells, e.g., T cells or NK cells, or the ratio of PD1 negative immune effector cells, e.g., T cells/NK cells/PD1 positive immune effector cells, e.g., T cells or NK cells, in the subject or harvested from the subject has been, at least transiently, increased.

In some embodiments, population of immune effector cells, e.g., T cells or NK cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/NK cells/PD1 positive immune effector cells, e.g., T cells or NK cells.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Allogenic CART

In embodiments described herein, the immune effector cell can be an allogenic immune effector cell, e.g., T cell or NK cell. For example, the cell can be an allogenic T cell, e.g., an allogenic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host. Such cells can be created throughout the use of one or more gene editing systems as described herein. In embodiments, the gene editing system targets a sequence encoding a component of the TCR, for example a sequence in the TCR alpha constant chain gene (TRAC) or its regulatory elements. In embodiments, the gene editing system targets a sequence encoding a component of the TCR, for example a sequence in the TCR beta constant chain gene (TRBC) or its regulatory elements.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. Such cells can be created through the use of one or more gene editing systems as described herein. In embodiments, the gene editing system targets a sequence encoding a component of one or more HLA molecules. In embodiments, the gene editing system targets a sequence encoding a factor which affects the expression of one or more HLA molecules. In embodiments, the gene editing system targets a regulator of MHC class I expression, for example a sequence encoding beta-2 microglobulin (B2M). In embodiments, the gene editing system targets a sequence encoding a regulator of MHC class II molecule expression, for example, CIITA. In embodiments, gene editing systems targeting both a regulator of MHC class I expression (for example, B2M) and a regulator of MHC class II molecule expression (e.g., CIITA) are introduced into the cells, such that at least MHC class I molecule and at least one MHC class II molecule expression is downregulated.

In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not express or expresses at low levels an inhibitory molecule, e.g. by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGF beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit, e.g., TCR or HLA

In some embodiments, TCR expression and/or HLA expression can be inhibited using siRNA or shRNA that targets a nucleic acid encoding a TCR and/or HLA in a T cell.

Expression of siRNA and shRNAs in T cells can be achieved using any conventional expression system, e.g., such as a lentiviral expression system.

Exemplary shRNAs that downregulate expression of components of the TCR are described, e.g., in US Publication No.: 2012/0321667. Exemplary siRNA and shRNA that downregulate expression of HLA class I and/or HLA class II genes are described, e.g., in U.S. publication No.: US 2007/0036773.

CRISPR to Inhibit, e.g., TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene.

Naturally-occurring CRISPR/Cas systems are found in approximately 40% of sequenced eubacteria genomes and 90% of sequenced archaea. Grissa et al. (2007) BMC Bioinformatics 8: 172. This system is a type of prokaryotic immune system that confers resistance to foreign genetic elements such as plasmids and phages and provides a form of acquired immunity. Barrangou et al. (2007) Science 315: 1709-1712; Marragini et al. (2008) Science 322: 1843-1845.

The CRISPR/Cas system has been modified for use in gene editing (silencing, enhancing or changing specific genes) in eukaryotes such as mice or primates. Wiedenheft et al. (2012) Nature 482: 331-8. This is accomplished by introducing into the eukaryotic cell a plasmid containing a specifically designed CRISPR and one or more appropriate Cas.

The CRISPR sequence, sometimes called a CRISPR locus, comprises alternating repeats and spacers. In a naturally-occurring CRISPR, the spacers usually comprise sequences foreign to the bacterium such as a plasmid or phage sequence; in the TCR and/or HLA CRISPR/Cas system, the spacers are derived from the TCR or HLA gene sequence.

RNA from the CRISPR locus is constitutively expressed and processed by Cas proteins into small RNAs. These comprise a spacer flanked by a repeat sequence. The RNAs guide other Cas proteins to silence exogenous genetic elements at the RNA or DNA level. Horvath et al. (2010) Science 327: 167-170; Makarova et al. (2006) Biology Direct 1: 7. The spacers thus serve as templates for RNA molecules, analogously to siRNAs. Pennisi (2013) Science 341: 833-836.

As these naturally occur in many different types of bacteria, the exact arrangements of the CRISPR and structure, function and number of Cas genes and their product differ somewhat from species to species. Haft et al. (2005) PLoS Comput. Biol. 1: e60; Kunin et al. (2007) Genome Biol. 8: R61; Mojica et al. (2005) J. Mol. Evol. 60: 174-182; Bolotin et al. (2005) Microbiol. 151: 2551-2561; Pourcel et al. (2005) Microbiol. 151: 653-663; and Stern et al. (2010) Trends. Genet. 28: 335-340. For example, the Cse (Cas subtype, E. coli) proteins (e.g., CasA) form a functional complex, Cascade, that processes CRISPR RNA transcripts into spacer-repeat units that Cascade retains. Brouns et al. (2008) Science 321: 960-964. In other prokaryotes, Cas6 processes the CRISPR transcript. The CRISPR-based phage inactivation in E. coli requires Cascade and Cas3, but not Cas1 or Cas2. The Cmr (Cas RAMP module) proteins in Pyrococcus furiosus and other prokaryotes form a functional complex with small CRISPR RNAs that recognizes and cleaves complementarity target RNAs. A simpler CRISPR system relies on the protein Cas9, which is a nuclease with two active cutting sites, one for each strand of the double helix. Combining Cas9 and modified CRISPR locus RNA can be used in a system for gene editing. Pennisi (2013) Science 341: 833-836.

The CRISPR/Cas system can thus be used to edit a TCR and/or HLA gene (adding or deleting one or more base pairs), or introducing a premature stop which thus decreases expression of a target gene or chromosomal sequence such as a TCR and/or HLA. The CRISPR/Cas system can alternatively be used like RNA interference, turning off TCR and/or HLA gene in a reversible fashion. In a mammalian cell, for example, the RNA can guide the Cas protein, e.g., a Cas protein lacking nuclease activity (e.g., dCas9), to a TCR and/or HLA promoter, sterically blocking RNA polymerases.

Artificial CRISPR/Cas systems can be generated which inhibit, for example, TCR and/or HLA, using technology known in the art, e.g., that described in U.S. Publication No. 20140068797. CRISPR systems which may be useful in the inventions described herein include those described in, for example, PCT application publication WO2017/093969, the contents of which are incorporated herein by reference in their entirety.

TALEN to Inhibit, e.g., TCR and/or HLA

"TALEN" or "TALEN to HLA and/or TCR" or "TALEN to inhibit HLA and/or TCR" refers to a transcription activator-like effector nuclease, an artificial nuclease which can be used to edit the HLA and/or TCR gene.

TALENs are produced artificially by fusing a TAL effector DNA binding domain to a DNA cleavage domain. Transcription activator-like effects (TALEs) can be engineered to bind any desired DNA sequence, including a portion of the HLA or TCR gene. By combining an engineered TALE with a DNA cleavage domain, a restriction enzyme can be produced which is specific to any desired DNA sequence, including a HLA or TCR sequence. These can then be introduced into a cell, wherein they can be used for genome editing. Boch (2011) Nature Biotech. 29: 135-6; and Boch et al. (2009) Science 326: 1509-12; Moscou et al. (2009) Science 326: 3501.

TALEs are proteins secreted by Xanthomonas bacteria. The DNA binding domain contains a repeated, highly conserved 33-34 amino acid sequence, with the exception of the 12th and 13th amino acids. These two positions are highly variable, showing a strong correlation with specific nucleotide recognition. They can thus be engineered to bind to a desired DNA sequence.

To produce a TALEN, a TALE protein is fused to a nuclease (N), which is a wild-type or mutated FokI endonuclease. Several mutations to FokI have been made for its use in TALENs; these, for example, improve cleavage specificity or activity. Cermak et al. (2011) Nucl. Acids Res. 39: e82; Miller et al. (2011) Nature Biotech. 29: 143-8; Hockemeyer et al. (2011) Nature Biotech. 29: 731-734; Wood et al. (2011) Science 333: 307; Doyon et al. (2010) Nature Methods 8: 74-79; Szczepek et al. (2007) Nature Biotech. 25: 786-793; and Guo et al. (2010) J. Mol. Biol. 200: 96.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity. Miller et al. (2011) *Nature Biotech.* 29: 143-8.

A HLA or TCR TALEN can be used inside a cell to produce a double-stranded break (DSB). A mutation can be introduced at the break site if the repair mechanisms improperly repair the break via non-homologous end joining. For example, improper repair may introduce a frame shift mutation. Alternatively, foreign DNA can be introduced into the cell along with the TALEN; depending on the sequences of the foreign DNA and chromosomal sequence, this process can be used to correct a defect in the HLA or TCR gene or introduce such a defect into a wt HLA or TCR gene, thus decreasing expression of HLA or TCR.

TALENs specific to sequences in HLA or TCR can be constructed using any method known in the art, including various schemes using modular components. Zhang et al. (2011) *Nature Biotech.* 29: 149-53; Geibler et al. (2011) *PLoS ONE* 6: e19509.

Zinc Finger Nuclease to Inhibit, e.g., HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR gene.

Like a TALEN, a ZFN comprises a FokI nuclease domain (or derivative thereof) fused to a DNA-binding domain. In the case of a ZFN, the DNA-binding domain comprises one or more zinc fingers. Carroll et al. (2011) *Genetics Society of America* 188: 773-782; and Kim et al. (1996) *Proc. Natl. Acad. Sci. USA* 93: 1156-1160.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart. Bitinaite et al. (1998) *Proc. Natl. Acad. Sci. USA* 95: 10570-5.

Also like a TALEN, a ZFN can create a double-stranded break in the DNA, which can create a frame-shift mutation if improperly repaired, leading to a decrease in the expression and amount of HLA and/or TCR in a cell. ZFNs can also be used with homologous recombination to mutate in the HLA or TCR gene.

ZFNs specific to sequences in HLA AND/OR TCR can be constructed using any method known in the art. Cathomen et al. (2008) *Mol. Ther.* 16: 1200-7; and Guo et al. (2010) *J. Mol. Biol.* 400: 96.

Activation and Expansion of Immune Effector Cells (e.g., T Cells)

Immune effector cells such as T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

Generally, invention population of immune effector cells may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody. Examples of an anti-CD28 antibody include 9.3, B-T3, XR-CD28 (Diaclone, Besançon, France) can be used as can other methods commonly known in the art (Berg et al., *Transplant Proc.* 30(8):3975-3977, 1998; Haanen et al., *J. Exp. Med.* 190(9):13191328, 1999; Garland et al., *J. Immunol Meth.* 227(1-2):53-63, 1999).

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values there between. In one aspect of the present invention, more anti-CD28 antibody is bound to the particles than anti-CD3 antibody, i.e., the ratio of CD3:CD28 is less than one. In certain aspects of the invention, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle: cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects of the present invention, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, or 5 billion/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells transduced with a nucleic acid encoding a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells, e.g., a CD19 CAR, CD20 CAR, CD22 CAR, or ROR1 CAR cell described herein, are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a CD19 CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a CD19 CAR, CD20 CAR, CD22 CAR, or ROR1 CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a CD19 CAR, CD20 CAR, CD22 CAR, or ROR1 CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

In one aspect of the present invention, the mixture may be cultured for several hours (about 3 hours) to about 14 days or any hourly integer value in between. In one aspect, the mixture may be cultured for 21 days. In one aspect of the invention the beads and the T cells are cultured together for about eight days. In one aspect, the beads and T cells are cultured together for 2-3 days. Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence IL-15 and/or IL-7 (e.g., IL-15 and IL-7).

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a CAR, e.g., CD20 CAR, is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a CAR, e.g., CD20 CAR, are described in further detail below.

Western blot analysis of CAR expression in primary T cells can be used to detect the presence of monomers and dimers. See, e.g., Milone et al., Molecular Therapy 17(8): 1453-1464 (2009). Very briefly, T cells (1:1 mixture of CD4+ and CD8+ T cells) expressing the CARs are expanded in vitro for more than 10 days followed by lysis and SDS-PAGE under reducing conditions. CARs containing the full length TCR-ζ cytoplasmic domain and the endogenous TCR-ζ chain are detected by western blotting using an antibody to the TCR-ζ chain. The same T cell subsets are used for SDS-PAGE analysis under non-reducing conditions to permit evaluation of covalent dimer formation.

In vitro expansion of CAR+ T cells following antigen stimulation can be measured by flow cytometry. For example, a mixture of CD4+ and CD8+ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the CD4+ and/or CD8+ T cell subsets by flow cytometry. See, e.g., Milone et al., Molecular Therapy 17(8): 1453-1464 (2009). Alternatively, a mixture of CD4+ and CD8+ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either CD19+ K562 cells (K562-CD19), wild-type K562 cells (K562 wild type) or K562 cells expressing hCD32 and 4-1BBL in the presence of antiCD3 and anti-CD28 antibody (K562-BBL-3/28) following washing. Exogenous IL-2 is added to the cultures every other day at 100 IU/ml. GFP+ T cells are enumerated by flow cytometry using bead-based counting. See, e.g., Milone et al., Molecular Therapy 17(8): 1453-1464 (2009). Similar assays can be performed using anti-CD20 T cells (see, e.g. Gill et al Blood 2014; 123:2343) or with anti-CD20 CAR T cells.

Sustained CAR+ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision, or Millipore Scepter following stimulation with αCD3/αCD28 coated magnetic beads on day 0, and transduction with the indicated CAR on day 1.

Animal models can also be used to measure a CART activity. For example, xenograft model using human CD19-specific CAR+ T cells to treat a primary human pre-B ALL in immunodeficient mice can be used. See, e.g., Milone et al., Molecular Therapy 17(8): 1453-1464 (2009). Very briefly, after establishment of ALL, mice are randomized as to treatment groups. Different numbers of αCD19-ζ and αCD19-BB-ζ engineered T cells are coinjected at a 1:1 ratio into NOD-SCID-$\gamma^{-/-}$ mice bearing B-ALL. The number of copies of αCD19-ζ and αCD19-BB-ζ vector in spleen DNA from mice is evaluated at various times following T cell injection. Animals are assessed for leukemia at weekly intervals. Peripheral blood CD19+ B-ALL blast cell counts are measured in mice that are injected with αCD19-ζ CAR+ T cells or mock-transduced T cells. Survival curves for the groups are compared using the log-rank test. In addition, absolute peripheral blood CD4+ and CD8+ T cell counts 4 weeks following T cell injection in NOD-SCID-$\gamma^{-/-}$ mice can also be analyzed. Mice are injected with leukemic cells and 3 weeks later are injected with T cells engineered to express CAR by a bicistronic lentiviral vector that encodes the CAR linked to eGFP. T cells are normalized to 45-50% input GFP+ T cells by mixing with mock-transduced cells prior to injection, and confirmed by flow cytometry. Animals are assessed for leukemia at 1-week intervals. Survival curves for the CAR+ T cell groups are compared using the log-rank test. Similar experiments can be done with CD20 CARTs.

Dose dependent CAR treatment response can be evaluated. See, e.g., Milone et al., Molecular Therapy 17(8): 1453-1464 (2009). For example, peripheral blood is obtained 35-70 days after establishing leukemia in mice injected on day 21 with CAR T cells, an equivalent number of mock-transduced T cells, or no T cells. Mice from each group are randomly bled for determination of peripheral blood CD19$^+$ ALL blast counts and then killed on days 35 and 49. The remaining animals are evaluated on days 57 and 70. Similar experiments can be done with CD20 CARTs.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with K562 cells expressing CD19 (K19) or CD32 and CD137 (KT32-BBL) for a final T-cell:K562 ratio of 2:1. K562 cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8$^+$ T cell expansion ex vivo. T cells are enumerated in cultures using CountBright™ fluorescent beads (Invitrogen, Carlsbad, Calif.) and flow cytometry as described by the manufacturer. CAR$^+$ T cells are identified by GFP expression using T cells that are engineered with eGFP-2A linked CAR-expressing lentiviral vectors. For CAR+ T cells not expressing GFP, the CAR+ T cells are detected with biotinylated recombinant CD19 protein and a secondary avidin-PE conjugate. CD4+ and CD8$^+$ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, Calif.) according the manufacturer's instructions or using a Luminex 30-plex kit (Invitrogen). Fluorescence is assessed using a BD Fortessa flow cytometer, and data is analyzed according to the manufacturer's instructions. Similar experiments can be done with CD20 CARTs.

Cytotoxicity can be assessed by a standard 51Cr-release assay. See, e.g., Milone et al., Molecular Therapy 17(8): 1453-1464 (2009). Briefly, target cells (K562 lines and primary pro-B-ALL cells) are loaded with 51Cr (as NaCrO4, New England Nuclear, Boston, Mass.) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, Mass.). Each condition is performed in at least triplicate, and the percentage of lysis is calculated using the formula: % Lysis=(ER−SR)/(TR−SR), where ER represents the average 51Cr released for each experimental condition.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/γc$^{−/−}$ (NSG) mice are injected IV with Nalm-6 cells followed 7 days later with T cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of CAR$^+$ T cells in Nalm-6 xenograft model can be measured as the following: NSG mice are injected with Nalm-6 transduced to stably express firefly luciferase, followed by a single tail-vein injection of T cells electroporated with a CAR 7 days later. Animals are imaged at various time points post injection. For example, photon-density heat maps of firefly luciferasepositive leukemia in representative mice at day 5 (2 days before treatment) and day 8 (24 hr post CAR$^+$ PBLs) can be generated.

Other assays, including those described in the Example section herein as well as those that are known in the art can also be used to evaluate the CD20 CAR or CD22 CAR constructs disclosed herein.

Therapeutic Application

CD20-, CD19-, and/or CD22-Associated Diseases and/or Disorders

The present invention provides, among other things, compositions and methods for treating a cancer or a disease associated with expression of CD20, CD19 and/or CD22 or condition associated with cells which express CD20, CD19 and/or CD22. In some embodiments, the cancer or disease includes, e.g., a proliferative disease such as a cancer or malignancy or a precancerous condition such as a myelodysplasia, a myelodysplastic syndrome or a preleukemia; or a noncancer related indication associated with cells which express CD20, CD19 and/or CD22. In one aspect, a cancer or disease associated with expression of CD20 is a hematological cancer. In one aspect, a hematological cancer includes but is not limited to a B-cell malignancy. In one aspect, the hematological cancer is a leukemia or a lymphoma. In one aspect, a cancer, e.g., a cancer associated with expression of CD20, CD19 and/or CD22, includes cancers and malignancies including, but not limited to, e.g., one or more acute leukemias including but not limited to B-cell acute lymphoid leukemia (BALL), T-cell acute lymphoid leukemia (TALL), small lymphocytic leukemia (SLL), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to mantle cell lymphoma (MCL), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, Marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and "preleukemia" (which is a diverse collection of hematological conditions united by ineffective production (or dysplasia) of myeloid blood cells). In some embodiments, to the disease associated with CD20, CD19 and/or CD22 expression includes, but not limited to, atypical and/or non-classical cancers, malignancies, precancerous conditions or proliferative diseases expressing CD20, CD19 and/or CD22, and any combination thereof.

Non-cancer related indications associated with expression of CD20 may also be included. Non-cancer related indications associated with expression of CD20 include, but are not limited to, e.g., autoimmune disease, (e.g., lupus, rheumatoid arthritis, multiple sclerosis autoimmune hemolytic anemia, pure red cell aplasia, idiopathic thrombocytopenic purpura, Evans syndrome, vasculitis, bullous skin disorders, type 1 diabetes mellitus, Sjogren's syndrome, anti-NMDA receptor encephalitis and Devic's disease, Graves' ophthalmopathy, and autoimmune pancreatitis), inflammatory disorders (allergy and asthma) and transplantation.

In one aspect, the invention provides methods for treating a disease associated with CD20, CD19 and/or CD22 expression. In one aspect, the invention provides methods for treating a disease wherein part of the tumor is negative for CD20, CD19 and/or CD22 and part of the tumor is positive for CD20, CD19 and/or CD22. For example, the CAR of the invention is useful for treating subjects that have undergone treatment for a disease associated with expression of CD20, CD19 and/or CD22, wherein the subject that has undergone treatment related to expression of CD20, CD19 and/or CD22 exhibits a disease associated with expression of CD20, CD19 and/or CD22.

In one aspect, the invention pertains to a vector comprising CAR as described herein operably linked to promoter for expression in mammalian T cells or NK cells. In one aspect, the invention provides a recombinant T cell expressing the CAR for use in treating CD20-, CD19- and/or CD22-expressing tumors, wherein the recombinant T cell expressing the CD20 CAR, CD19 CAR or CD22 CAR is termed a CD20 CART, CD19 CART or CD22 CART, respectively. In one aspect, the CD19 CART or CD22 CART of the invention is capable of contacting a tumor cell with at least one CD20 CAR, CD19 CAR or CD22 CAR of the invention expressed on its surface such that the CART targets the tumor cell and growth of the tumor is inhibited.

In one aspect, the invention pertains to a method of inhibiting growth of a CD20-CD19- and/or CD22-expressing tumor cell, comprising contacting the tumor cell with a CD20 CD19- and/or CD22-CAR T cell or a CD20 CD19- and/or CD22-CAR-expressing NK cell of the present invention such that the CAR-expressing cell is activated in response to the antigen and targets the cancer cell, wherein the growth of the tumor is inhibited.

In one aspect, the invention pertains to a method of treating cancer in a subject. The method comprises administering to the subject a CD20, CD19- and/or CD22-CAR-expressing cell of the present invention such that the cancer is treated in the subject. An example of a cancer that is treatable by the CD20, CD19- and/or CD22-CAR-expressing cell of the invention is a cancer associated with expression of CD20. An example of a cancer that is treatable by the CD20, CD19- and/or CD22-CAR-expressing cell of the invention includes but is not limited to a hematological cancer described herein. The invention includes a type of cellular therapy where cells are genetically modified to express a chimeric antigen receptor (CAR) and the CAR-expressing cell is infused to a recipient in need thereof. The infused cell is able to kill tumor cells in the recipient. Unlike antibody therapies, CAR-modified cells are able to replicate in vivo resulting in long-term persistence that can lead to sustained tumor control. In various aspects, the T cells administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the cell to the patient.

The invention also includes a type of cellular therapy where immune effector cells, e.g., NK cells or T cells are modified, e.g., by in vitro transcribed RNA, to transiently express a chimeric antigen receptor (CAR) and the CAR-expressing (e.g., CART or CAR-expressing NK) cell is infused to a recipient in need thereof. The infused cell is able to kill cancer cells in the recipient. Thus, in various aspects, the CAR-expressing cells, e.g., T or NK cells, administered to the patient, is present for less than one month, e.g., three weeks, two weeks, one week, after administration of the CAR-expressing cell, e.g., T or NK cell, to the patient.

Without wishing to be bound by any particular theory, the anti-tumor immunity response elicited by the CAR-modified T cells or NK cells may be an active or a passive immune response, or alternatively may be due to a direct vs indirect immune response. In one aspect, the CAR transduced T cells or NK cells exhibit specific proinflammatory cytokine secretion and potent cytolytic activity in response to human cancer cells expressing CD20, resist soluble CD20 inhibition, mediate bystander killing and mediate regression of an established human tumor. For example, antigen-less tumor cells within a heterogeneous field of CD20-expressing tumor may be susceptible to indirect destruction by CD20-redirected T cells or NK cells that has previously reacted against adjacent antigen-positive cancer cells.

In one aspect, the CAR-modified cells of the invention, e.g., fully human CAR-expressing cells, may be a type of vaccine for ex vivo immunization and/or in vivo therapy in a mammal. In one aspect, the mammal is a human.

With respect to ex vivo immunization, at least one of the following occurs in vitro prior to administering the cell into a mammal: i) expansion of the cells, ii) introducing a nucleic acid encoding a CAR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of T cells comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-modified cells of the invention are used in the treatment of diseases, disorders and conditions associated with expression of CD20. In certain aspects, the cells of the invention are used in the treatment of patients at risk for developing diseases, disorders and conditions associated with expression of CD20. Thus, the present invention provides methods for the treatment or prevention of diseases, disorders and conditions associated with expression of CD20 comprising administering to a subject in need thereof, a therapeutically effective amount of the CAR-modified cells of the invention.

In one aspect the CAR-expressing cells of the inventions may be used to treat a proliferative disease such as a cancer or malignancy or is a precancerous condition such as a myelodysplasia, a myelodysplastic syndrome or a preleukemia. In one aspect, a cancer associated with expression of CD20 is a hematological cancer preleukemia, hyperproliferative disorder, hyperplasia or a dysplasia, which is characterized by abnormal growth of cells.

In one aspect, the CAR-expressing cells of the invention are used to treat a cancer, wherein the cancer is a hematological cancer. Hematological cancer conditions are the types of cancer such as leukemia and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

In one aspect, the compositions and CAR-expressing cells of the present invention are particularly useful for treating B cell malignancies, such as non-Hodgkin lymphomas, e.g., DLBCL, Follicular lymphoma, or CLL.

Non-Hodgkin lymphoma (NHL) is a group of cancers of lymphocytes, formed from either B or T cells. NHLs occur at any age and are often characterized by lymph nodes that are larger than normal, weight loss, and fever. Different types of NHLs are categorized as aggressive (fast-growing) and indolent (slow-growing) types. B-cell non-Hodgkin lymphomas include Burkitt lymphoma, chronic lymphocytic leukemia/small lymphocytic lymphoma (CLL/SLL), diffuse large B-cell lymphoma (DLBCL), follicular lymphoma, immunoblastic large cell lymphoma, precursor B-lymphoblastic lymphoma, and mantle cell lymphoma. Examples of T-cell non-Hodgkin lymphomas include mycosis fungoides, anaplastic large cell lymphoma, and precursor T-lymphoblastic lymphoma. Lymphomas that occur after bone marrow or stem cell transplantation are typically B-cell non-Hodgkin lymphomas. See, e.g., Maloney. NEJM. 366.21 (2012):2008-16.

Diffuse large B-cell lymphoma (DLBCL) is a form of NHL that develops from B cells. DLBCL is an aggressive lymphoma that can arise in lymph nodes or outside of the lymphatic system, e.g., in the gastrointestinal tract, testes, thyroid, skin, breast, bone, or brain. Three variants of cellular morphology are commonly observed in DLBCL: centroblastic, immunoblastic, and anaplastic. Centroblastic morphology is most common and has the appearance of medium-to-large-sized lymphocytes with minimal cytoplasm. There are several subtypes of DLBCL. For example, primary central nervous system lymphoma is a type of DLBCL that only affects the brain is called and is treated differently than DLBCL that affects areas outside of the brain. Another type of DLBCL is primary mediastinal B-cell lymphoma, which often occurs in younger patients and grows rapidly in the chest. Symptoms of DLBCL include a painless rapid swelling in the neck, armpit, or groin, which is caused by enlarged lymph nodes. For some subjects, the swelling may be painful. Other symptoms of DLBCL include night sweats, unexplained fevers, and weight loss. Although most patients with DLBCL are adults, this disease sometimes occurs in children. Treatment for DLBCL includes chemotherapy (e.g., cyclophosphamide, doxorubicin, vincristine, prednisone, etoposide), antibodies (e.g., Rituxan), radiation, or stem cell transplants.

Follicular lymphoma a type of non-Hodgkin lymphoma and is a lymphoma of follicle center B-cells (centrocytes and centroblasts), which has at least a partially follicular pattern. Follicular lymphoma cells express the B-cell markers CD10, CD19, CD20, and CD22. Follicular lymphoma cells are commonly negative for CD5. Morphologically, a follicular lymphoma tumor is made up of follicles containing a mixture of centrocytes (also called cleaved follicle center cells or small cells) and centroblasts (also called large noncleaved follicle center cells or large cells). The follicles are surrounded by non-malignant cells, mostly T-cells. The follicles contain predominantly centrocytes with a minority of centroblasts. The World Health Organization (WHO) morphologically grades the disease as follows: grade 1 (<5 centroblasts per high-power field (hpf); grade 2 (6-15 centroblasts/hpf); grade 3 (>15 centroblasts/hpf). Grade 3 is further subdivided into the following grades: grade 3A (centrocytes still present); grade 3B (the follicles consist almost entirely of centroblasts). Treatment of follicular lymphoma includes chemotherapy, e.g., alkyating agents, nucleoside analogs, anthracycline-containing regimens, e.g., a combination therapy called CHOP-cyclophosphamide, doxorubicin, vincristine, prednisone/prednisolone, antibodies (e.g., rituximab), radioimmunotherapy, and hematopoietic stem cell transplantation.

CLL is a B-cell malignancy characterized by neoplastic cell proliferation and accumulation in bone morrow, blood, lymph nodes, and the spleen. The median age at time of diagnosis of CLL is about 65 years. Current treatments include chemotherapy, radiation therapy, biological therapy, or bone marrow transplantation. Sometimes symptoms are treated surgically (e.g., splenectomy removal of enlarged spleen) or by radiation therapy (e.g., de-bulking swollen lymph nodes). Chemotherapeutic agents to treat CLL include, e.g., fludarabine, 2-chlorodeoxyadenosine (cladribine), chlorambucil, vincristine, pentostatin, cyclophosphamide, alemtuzumab (Campath-1H), doxorubicin, and prednisone. Biological therapy for CLL includes antibodies, e.g., alemtuzumab, rituximab, and ofatumumab; as well as tyrosine kinase inhibitor therapies. A number of criteria can be used to classify stage of CLL, e.g., the Rai or Binet system. The Rai system describes CLL has having five stages: stage 0 where only lymphocytosis is present; stage I where lymphadenopathy is present; stage II where splenomegaly, lymphadenopathy, or both are present; stage III where anemia, organomegaly, or both are present (progression is defined by weight loss, fatigue, fever, massive organomegaly, and a rapidly increasing lymphocyte count); and stage IV where anemia, thrombocytopenia, organomegaly, or a combination thereof are present. Under the Binet staging system, there are three categories: stage A where lymphocytosis is present and less than three lymph nodes are enlarged (this stage is inclusive of all Rai stage 0 patients, one-half of Rai stage I patients, and one-third of Rai stage II patients); stage B where three or more lymph nodes are involved; and stage C wherein anemia or thrombocytopenia, or both are present. These classification systems can be combined with measurements of mutation of the immunoglobulin genes to provide a more accurate characterization of the state of the disease. The presence of mutated immunoglobulin genes correlates to improved prognosis.

In another embodiment, the CAR-expressing cells of the present invention are used to treat cancers or leukemias, e.g., with leukemia stem cells. For example, the leukemia stem cells are CD34$^+$/CD38$^-$ leukemia cells.

The present invention provides, among other things, compositions and methods for treating cancer. In one aspect, the cancer is a hematologic cancer including but is not limited to one or more acute leukemias including but not limited to B-cell acute lymphoid leukemia (BALL), T-cell acute lymphoid leukemia (TALL), small lymphocytic leukemia (SLL), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to mantle cell lymphoma (MCL), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, Marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and "preleukemia" which is a diverse collection of hematological conditions united by ineffective production (or dysplasia) of myeloid blood cells, and to disease associated with CD20 expression include, but not limited to atypical and/or non-classical cancers, malignancies, precancerous conditions or proliferative diseases expressing CD20; and any combination thereof.

The CAR-modified cells of the present invention may be administered either alone, or as a pharmaceutical composition in combination with diluents and/or with other components such as IL-2 or other cytokines or cell populations.

In another aspect, the CAR-expressing cells of the invention may be used for treatment of a subject previously treated with a CD19 CAR-expressing cell. In some embodiments, the CAR-expressing cell of the invention is administered post-relapse of a cancer or other condition previously treated with CD19 CAR-expressing cell.

In some embodiments, the cancer or other condition is CD19 expressing. In some embodiments, the cancer or other condition is CD20 expressing. In some embodiments, the cancer or other condition is CD19 and CD20 expressing.

In some embodiments, the cancer or other condition has not previously been responsive to CD19 CAR-expressing cell. In some embodiments, the subject cancer or other condition is responsive to treatment with CD19 CAR-expressing cell. In some embodiments, the cancer or other condition was more responsive to treatment with CD19 CAR-expressing cell than it is presently. In some embodiments, the cancer or other condition was responsive to treatment with CD19 CAR-expressing cell. In some embodiments, the cancer or other condition was responsive to treatment with CD19 CAR-expressing cell and is no longer responsive to CD19 CAR-expressing cell.

In some embodiments, CD19 CAR-expressing cell and CD20 CAR-expressing cell (e.g., as described herein) are administered concurrently. In some embodiments, CD19 CAR-expressing cell and CD20 CAR-expressing cell (e.g., as described herein) are administered concurrently due to a reduction or loss of responsiveness to CD19 CAR-expressing cell. In some embodiments, CD19 CAR-expressing cell therapy has been discontinued. In some embodiments, CD19 CAR therapy has been discontinued due to a reduction or loss of responsiveness to CD19 CAR-expressing cell.

In some embodiments, CD19 CAR-expressing cell and CD22 CAR-expressing cell (e.g., as described herein) are administered concurrently. In some embodiments, CD19 CAR-expressing cell and CD22 CAR-expressing cell (e.g., as described herein) are administered concurrently due to a reduction or loss of responsiveness to CD19 CAR-expressing cell. In some embodiments, CD19 CAR-expressing cell therapy has been discontinued. In some embodiments, CD19 CAR therapy has been discontinued due to a reduction or loss of responsiveness to CD19 CAR-expressing cell.

In some embodiments, CD22 CAR-expressing cell and CD20 CAR-expressing cell (e.g., as described herein) are administered concurrently. In some embodiments, CD22 CAR-expressing cell and CD20 CAR-expressing cell (e.g., as described herein) are administered concurrently due to a reduction or loss of responsiveness to CD22 CAR-expressing cell. In some embodiments, CD22 CAR-expressing cell therapy has been discontinued. In some embodiments, CD22 CAR therapy has been discontinued due to a reduction or loss of responsiveness to CD22 CAR-expressing cell.

In some embodiments, CD22 CAR-expressing cell and CD20 CAR-expressing cell (e.g., as described herein) are administered concurrently. In some embodiments, CD22 CAR-expressing cell and CD20 CAR-expressing cell (e.g., as described herein) are administered concurrently due to a reduction or loss of responsiveness to CD20 CAR-expressing cell. In some embodiments, CD20 CAR-expressing cell therapy has been discontinued. In some embodiments, CD20 CAR therapy has been discontinued due to a reduction or loss of responsiveness to CD20 CAR-expressing cell.

The present invention also provides methods for inhibiting the proliferation or reducing a CD20-expressing cell population, the methods comprising contacting a population of cells comprising a CD20-expressing cell with a CD20 CAR-expressing cell of the invention that binds to the CD20-expressing cell. In a specific aspect, the present invention provides methods for inhibiting the proliferation or reducing the population of cancer cells expressing CD20, the methods comprising contacting the CD20-expressing cancer cell population with a CD20 CAR-expressing cell of the invention that binds to the CD20-expressing cell. In one aspect, the present invention provides methods for inhibiting the proliferation or reducing the population of cancer cells expressing CD20, the methods comprising contacting the CD20-expressing cancer cell population with a CD20 CAR-expressing cell of the invention that binds to the CD20-expressing cell. In certain aspects, the CD20 CAR-expressing cell of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for B-cell malignancy or another cancer associated with CD20-expressing cells relative to a negative control. In one aspect, the subject is a human.

The present invention also provides methods for preventing, treating and/or managing a disease associated with CD20-expressing cells (e.g., a hematologic cancer or atypical cancer expressing CD20), the methods comprising administering to a subject in need a CD20 CAR-expressing cell of the invention that binds to the CD20-expressing cell. In one aspect, the subject is a human. Non-limiting examples of disorders associated with CD20-expressing cells include autoimmune diseases, (e.g., lupus, rheumatoid arthritis, multiple sclerosis autoimmune hemolytic anemia, pure red cell aplasia, idiopathic thrombocytopenic purpura, Evans syndrome, vasculitis, bullous skin disorders, type 1 diabetes mellitus, Sjogren's syndrome, anti-NMDA receptor encephalitis and Devic's disease, Graves' ophthalmopathy, and autoimmune pancreatitis), inflammatory disorders (allergy and asthma), transplantation, and cancers (such as hematological cancers or atypical cancers expressing CD20).

The present invention also provides methods for preventing, treating and/or managing a disease associated with CD20-expressing cells, the methods comprising administering to a subject in need a CD20 CAR-expressing cell of the invention that binds to the CD20-expressing cell. In one aspect, the subject is a human.

The present invention provides methods for preventing relapse of cancer associated with CD20-expressing cells, the methods comprising administering to a subject in need thereof a CD20 CAR-expressing cell of the invention that binds to the CD20-expressing cell. In one aspect, the methods comprise administering to the subject in need thereof an effective amount of a CD20 CAR-expressing cell described herein that binds to the CD20-expressing cell in combination with an effective amount of another therapy.

In some embodiments, the CD20 expressing cell expresses CD19, CD123, FLT-3, ROR-1, CD79b, CD179b, CD79a, CD10, CD34, and/or CD22. In certain embodiments, the CD20 expressing cell expresses CD19. In some embodiments, the CD20-expressing cell does not express CD19.

In some embodiments, the subject is a non-responder to CD19 CAR therapy. In some embodiments, the subject is a partial responder to CD19 CAR therapy. In some embodiments, the subject is a complete responder to CD19 CAR therapy. In some embodiments, the subject is a non-relapser to CD19 CAR therapy. In some embodiments, the subject is a relapser to CD19 CAR therapy.

In some embodiments, a cancer or other condition that was previously responsive to treatment with CD19 CAR-expressing cells does not express CD19. In some embodiments, a cancer or other condition that was previously responsive to treatment with CD19 CAR-expressing cells has a 10%, 20%, 30%, 40%, 50% or more reduction in CD19 expression levels relative to when the cancer or other condition was responsive to treatment with CD19 CAR-expressing cells. In some embodiments, a cancer or other condition that was previously responsive to treatment with CD19 CAR-expressing cells expresses CD22 and/or CD123.

In some embodiments, the CD20 CAR-expressing cell of the invention is administered post-relapse of a cancer or other condition previously treated with CD19 CAR-expressing cell. In some embodiments, a CD19 CAR-expressing cell and a CD20 CAR-expressing cell are administered concurrently, as described herein.

Bone Marrow Ablation

In one aspect, the present invention provides compositions and methods for bone marrow ablation. For example, in one aspect, the invention provides compositions and methods for eradication of at least a portion of existing bone marrow in a subject. It is described herein that, in certain instances, the CD20-expressing cells comprising a CD20 CAR of the present invention eradicates CD20 positive bone marrow myeloid progenitor cells.

In one aspect, the invention provides a method of bone marrow ablation comprising administering a CD20 CAR-expressing cell of the invention to a subject in need of bone marrow ablation. For example, the present method may be used to eradicate some or all of the existing bone marrow of a subject having a disease or disorder in which bone marrow transplantation or bone marrow reconditioning is a beneficial treatment strategy. In one aspect, the bone marrow ablation method of the invention, comprising the administration of a CD20 CAR-expressing cell described elsewhere herein, is performed in a subject prior to bone marrow transplantation. Thus, in one aspect, the method of the invention provides a cellular conditioning regimen prior to bone marrow or stem cell transplantation. In one aspect, bone marrow transplantation comprises transplantation of a stem cell. The bone marrow transplantation may comprise transplantation of autologous or allogeneic cells.

The present invention provides a method of treating a disease or disorder comprising administering a CD20-expressing cell of the invention to eradicate at least a portion of existing bone marrow. The method may be used as at least a portion of a treatment regimen for treating any disease or disorder where bone marrow transplantation is beneficial. That is, the present method may be used in any subject in need of a bone marrow transplant. In one aspect, bone marrow ablation comprising administration of a CD20-expressing cell is useful in the treatment of AML. In certain aspects, bone marrow ablation by way of the present method is useful in treating a hematological cancer, a solid tumor, a hematologic disease, a metabolic disorder, HIV, HTLV, a lysosomal storage disorder, and an immunodeficiency.

Compositions and methods disclosed herein may be used to eradicate at least a portion of existing bone marrow to treat hematological cancers including, but not limited to cancers described herein, e.g., leukemia, lymphoma, myeloma, ALL, AML, CLL, CML, Hodgkin lymphoma, Non-Hodgkin lymphoma (e.g., DLBCL or follicular lymphoma), and multiple myeloma.

Compositions and methods disclosed herein may be used to treat hematologic diseases including, but not limited to myelodysplasia, anemia, paroxysmal nocturnal hemoglobinuria, aplastic anemia, acquired pure red cell anemia, Diamon-Blackfan anemia, Fanconi anemia, cytopenia, amegakaryotic thrombocytopenia, myeloproliferative disorders, polycythemia vera, essential thrombocytosis, myelofibrosis, hemoglobinopathies, sickle cell disease, β thalassemia major, among others.

In one aspect, the present invention provides a method of treating cancer comprising bone marrow conditioning, where at least a portion of bone marrow of the subject is eradicated by the CD20 CAR-expressing cell of the invention. For example, in certain instances, the bone marrow of the subject comprises a malignant precursor cell that can be targeted and eliminated by the activity of the CD20 CAR-expressing cell. In one aspect, a bone marrow conditioning therapy comprises administering a bone marrow or stem cell transplant to the subject following the eradication of native bone marrow. In one aspect, the bone marrow reconditioning therapy is combined with one or more other anti-cancer therapies, including, but not limited to anti-tumor CAR therapies, chemotherapy, radiation, and the like.

In one aspect, eradication of the administered CD20 CAR-expressing cell may be required prior to infusion of bone marrow or stem cell transplant. Eradication of the CD20 CAR-expressing cell may be accomplished using any suitable strategy or treatment, including, but not limited to, use of a suicide gene, limited CAR persistence using RNA encoded CARs, or anti-T cell modalities including antibodies or chemotherapy.

CD22 Associated Diseases and/or Disorders

The present disclosure provides, among other things, compositions and methods for treating a disease associated with expression of CD22 or condition associated with cells which express CD22 including, e.g., a proliferative disease such as a cancer or malignancy or a precancerous condition; or a noncancer related indication associated with cells which express CD22. In one aspect, a cancer associated with expression of CD22 is a hematological cancer. In one aspect, a hematological cancer includes but is not limited to a B-cell malignancy. In one aspect, the hematological cancer is a leukemia or a lymphoma. In one aspect, a cancer associated with expression of CD22 includes cancers and malignancies including, but not limited to, e.g., one or more acute leukemias including but not limited to B-cell acute lymphoid leukemia (BALL), T-cell acute lymphoid leukemia (TALL), small lymphocytic leukemia (SLL), acute lymphoid leukemia (ALL); one or more chronic leukemias including but not limited to chronic lymphocytic leukemia (CLL); additional hematologic cancers or hematologic conditions including, but not limited to mantle cell lymphoma (MCL), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, Marginal zone lymphoma, non-Hodgkin lymphoma, Hodgkin lymphoma, plasmablastic lymphoma, plasmacytoid dendritic cell neoplasm, and Waldenstrom macroglobulinemia. In another embodiment, the disease associated with CD22 expression includes, but not limited to, atypical and/or non-classical cancers, malignancies, precancerous conditions or proliferative diseases expressing CD22; and any combination thereof.

Non-cancer related indications associated with expression of CD22 may also be included. Non-cancer related indications associated with expression of CD22 include, but are not limited to, e.g., autoimmune disease, (e.g., lupus, rheumatoid arthritis, multiple sclerosis autoimmune hemolytic anemia, pure red cell aplasia, idiopathic thrombocytopenic purpura, Evans syndrome, vasculitis, bullous skin disorders, type 1 diabetes mellitus, Sjogren's syndrome, anti-NMDA receptor encephalitis and Devic's disease, Graves' ophthalmopathy, and autoimmune pancreatitis), inflammatory disorders (allergy and asthma) and solid-organ or hematopoietic cell transplantation.

In one aspect, the disclosure provides methods for treating a disease associated with CD22 expression. In one aspect, the disclosure provides methods for treating a disease wherein part of the tumor is negative for CD22 and part of the tumor is positive for CD22. For example, the CAR of the disclosure is useful for treating subjects that have undergone treatment for a disease associated with expression of CD22, wherein the subject that has undergone treatment related to expression of CD22 exhibits a disease associated with expression of CD22.

In one aspect, the disclosure pertains to a vector comprising CD22 CAR operably linked to promoter for expression in mammalian cells (e.g., T cells or NK cells). In one aspect, the disclosure provides a recombinant T cell expressing the CD22 CAR for use in treating CD22-expressing tumors, wherein the recombinant T cell expressing the CD22 CAR is termed a CD22 CART. In one aspect, the CD22 CART or CD22 CAR expressing NK cell of the disclosure is capable of contacting a tumor cell with at least one CD22 CAR of the disclosure expressed on its surface such that the CART or CD22 CAR expressing NK cell targets the tumor cell and growth of the tumor is inhibited.

In one aspect, the disclosure pertains to a method of inhibiting growth of a CD22-expressing tumor cell, comprising contacting the tumor cell with a CD22 CAR cell (e.g., T cell or NK cell) of the present disclosure such that the CART is activated in response to the antigen and targets the cancer cell, wherein the growth of the tumor is inhibited.

In one aspect, the disclosure pertains to a method of treating cancer in a subject. The method comprises administering to the subject a CD22 CAR expressing cell (e.g., T cell or NK cell) of the present disclosure such that the cancer is treated in the subject. An example of a cancer that is treatable by the CD22 CAR expressing cell (e.g., T cell or NK cell) of the disclosure is a cancer associated with expression of CD22. An example of a cancer that is treatable by the CD22 CAR expressing cell (e.g., T cell or NK cell) of the disclosure includes but is not limited to a hematological cancer described herein.

The disclosure includes a type of cellular therapy where cells (e.g., T cells or NK cells) are genetically modified to express a chimeric antigen receptor (CAR) and the CAR expressing cell (e.g., T cell or NK cells) is infused to a recipient in need thereof. The infused cell is able to kill tumor cells in the recipient. Unlike antibody therapies, CAR-modified cells (e.g., T cells or NK cells) are able to replicate in vivo resulting in long-term persistence that can lead to sustained tumor control. In various aspects, the cells (e.g., T cells or NK cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell to the patient.

The disclosure also includes a type of cellular therapy where immune effector cells, e.g., NK cells or T cells are modified, e.g., by in vitro transcribed RNA, to transiently express a chimeric antigen receptor (CAR) and the CAR-expressing (e.g., CART or CAR expressing NK cell) cell is infused to a recipient in need thereof. The infused cell is able to kill cancer cells in the recipient. Thus, in various aspects, the CAR-expressing cells, e.g., T cells or NK cells, are administered to the patient, is present for less than one month, e.g., three weeks, two weeks, one week, after administration of the CAR-expressing cell, e.g., T cells or NK cell, to the patient.

Without wishing to be bound by any particular theory, the anti-tumor immunity response elicited by the CAR-modified cells (e.g., T cells or NK cells) may be an active or a passive immune response, or alternatively may be due to a direct vs indirect immune response. In one aspect, the CAR transduced cells (e.g., T cells or NK cells) exhibit specific proinflammatory cytokine secretion and potent cytolytic activity in response to human cancer cells expressing CD22, resist soluble CD22 inhibition, mediate bystander killing and mediate regression of an established human tumor. For example, antigen-less tumor cells within a heterogeneous field of CD22-expressing tumor may be susceptible to indirect destruction by CD22-redirected T cells that has previously reacted against adjacent antigen-positive cancer cells.

In one aspect, the CAR-modified cells (e.g., T cells or NK cells) of the disclosure, e.g., fully human CAR-expressing cells, may be a type of vaccine for ex vivo immunization and/or in vivo therapy in a mammal. In one aspect, the mammal is a human.

With respect to ex vivo immunization, at least one of the following occurs in vitro prior to administering the cell into a mammal: i) expansion of the cells, ii) introducing a nucleic acid encoding a CAR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present disclosure. Other suitable methods are known in the art, therefore the present disclosure is not limited to any particular method of ex vivo expansion of the cells. Briefly, ex vivo culture and expansion of T cells comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present disclosure also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-modified cells (e.g., T cells or NK cells) of the disclosure are used in the treatment of diseases, disorders and conditions associated with expression of CD22. In certain aspects, the cells of the disclosure are used in the treatment of patients at risk for developing diseases, disorders and conditions associated with expression of CD22. Thus, the present disclosure provides methods for the treatment or prevention of diseases, disorders and conditions associated with expression of CD22 comprising administering to a subject in need thereof, a therapeutically effective amount of the CAR-modified cells (e.g., T cells or NK cells) of the disclosure.

In one aspect the CAR expressing cells of the disclosures may be used to treat a proliferative disease such as a cancer or malignancy or is a precancerous condition. In one aspect, a cancer associated with expression of CD22 is a hematological cancer preleukemia, hyperproliferative disorder, hyperplasia or a dysplasia, which is characterized by abnormal growth of cells.

In one aspect, the CAR expressing cells of the disclosure are used to treat a cancer, wherein the cancer is a hematological cancer. Hematological cancer conditions are the types of cancer such as leukemia and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

In one aspect, the compositions and CART cells or CAR expressing NK cells of the present disclosure are particularly useful for treating B cell malignancies, such as non-Hodgkin lymphomas, e.g., DLBCL, Follicular lymphoma, or CLL.

Non-Hodgkin lymphoma (NHL) is a group of cancers of lymphocytes, formed from either B or T cells. NHLs occur at any age and are often characterized by lymph nodes that are larger than normal, weight loss, and fever. Different types of NHLs are categorized as aggressive (fast-growing) and indolent (slow-growing) types. B-cell non-Hodgkin lymphomas include Burkitt lymphoma, chronic lymphocytic leukemia/small lymphocytic lymphoma (CLL/SLL), diffuse large B-cell lymphoma (DLBCL), follicular lymphoma, immunoblastic large cell lymphoma, precursor B-lymphoblastic lymphoma, and mantle cell lymphoma. Examples of T-cell non-Hodgkin lymphomas include mycosis fungoides, anaplastic large cell lymphoma, and precursor T-lymphoblastic lymphoma. Lymphomas that occur after bone marrow or stem cell transplantation are typically B-cell non-Hodgkin lymphomas. See, e.g., Maloney. NEJM. 366.21 (2012):2008-16.

Diffuse large B-cell lymphoma (DLBCL) is a form of NHL that develops from B cells. DLBCL is an aggressive lymphoma that can arise in lymph nodes or outside of the lymphatic system, e.g., in the gastrointestinal tract, testes, thyroid, skin, breast, bone, or brain. Three variants of cellular morphology are commonly observed in DLBCL: centroblastic, immunoblastic, and anaplastic. Centroblastic morphology is most common and has the appearance of medium-to-large-sized lymphocytes with minimal cytoplasm. There are several subtypes of DLBCL. For example, primary central nervous system lymphoma is a type of DLBCL that only affects the brain is called and is treated differently than DLBCL that affects areas outside of the brain. Another type of DLBCL is primary mediastinal B-cell lymphoma, which often occurs in younger patients and grows rapidly in the chest. Symptoms of DLBCL include a painless rapid swelling in the neck, armpit, or groin, which is caused by enlarged lymph nodes. For some subjects, the swelling may be painful. Other symptoms of DLBCL include night sweats, unexplained fevers, and weight loss. Although most patients with DLBCL are adults, this disease sometimes occurs in children. Treatment for DLBCL includes chemotherapy (e.g., cyclophosphamide, doxorubicin, vincristine, prednisone, etoposide), antibodies (e.g., Rituxan), radiation, or stem cell transplants.

Follicular lymphoma a type of non-Hodgkin lymphoma and is a lymphoma of follicle center B-cells (centrocytes and centroblasts), which has at least a partially follicular pattern. Follicular lymphoma cells express the B-cell markers CD10, CD19, CD20, and CD22. Follicular lymphoma cells are commonly negative for CD5. Morphologically, a follicular lymphoma tumor is made up of follicles containing a mixture of centrocytes (also called cleaved follicle center cells or small cells) and centroblasts (also called large noncleaved follicle center cells or large cells). The follicles are surrounded by non-malignant cells, mostly T-cells. The follicles contain predominantly centrocytes with a minority of centroblasts. The World Health Organization (WHO) morphologically grades the disease as follows: grade 1 (<5 centroblasts per high-power field (hpf); grade 2 (6-15 centroblasts/hpf); grade 3 (>15 centroblasts/hpf). Grade 3 is further subdivided into the following grades: grade 3A (centrocytes still present); grade 3B (the follicles consist almost entirely of centroblasts). Treatment of follicular lymphoma includes chemotherapy, e.g., alkyating agents, nucleoside analogs, anthracycline-containing regimens, e.g., a combination therapy called CHOP-cyclophosphamide, doxorubicin, vincristine, prednisone/prednisolone, antibodies (e.g., rituximab), radioimmunotherapy, and hematopoietic stem cell transplantation.

CLL is a B-cell malignancy characterized by neoplastic cell proliferation and accumulation in bone morrow, blood, lymph nodes, and the spleen. The median age at time of diagnosis of CLL is about 65 years. Current treatments include chemotherapy, radiation therapy, biological therapy, or bone marrow transplantation. Sometimes symptoms are treated surgically (e.g., splenectomy removal of enlarged spleen) or by radiation therapy (e.g., de-bulking swollen lymph nodes). Chemotherapeutic agents to treat CLL include, e.g., fludarabine, 2-chlorodeoxyadenosine (cladribine), chlorambucil, vincristine, pentostatin, cyclophosphamide, alemtuzumab (Campath-1H), doxorubicin, and prednisone. Biological therapy for CLL includes antibodies, e.g., alemtuzumab, rituximab, and ofatumumab; as well as tyrosine kinase inhibitor therapies. A number of criteria can be used to classify stage of CLL, e.g., the Rai or Binet system. The Rai system describes CLL has having five stages: stage 0 where only lymphocytosis is present; stage I where lymphadenopathy is present; stage II where splenomegaly, lymphadenopathy, or both are present; stage III where anemia, organomegaly, or both are present (progression is defined by weight loss, fatigue, fever, massive organomegaly, and a rapidly increasing lymphocyte count); and stage IV where anemia, thrombocytopenia, organomegaly, or a combination thereof are present. Under the Binet staging system, there are three categories: stage A where lymphocytosis is present and less than three lymph nodes are enlarged (this stage is inclusive of all Rai stage 0 patients, one-half of Rai stage I patients, and one-third of Rai stage II patients); stage B where three or more lymph nodes are involved; and stage C wherein anemia or thrombocytopenia, or both are present. These classification systems can be combined with measurements of mutation of the immunoglobulin genes to provide a more accurate characterization of the state of the disease. The presence of mutated immunoglobulin genes correlates to improved prognosis.

In another embodiment, the CAR expressing cells of the present disclosure are used to treat cancers or leukemias, e.g., with leukemia stem cells. For example, the leukemia stem cells are $CD34^+/CD38^-$ leukemia cells.

The present disclosure provides, among other things, compositions and methods for treating cancer. In one aspect, the cancer is a hematologic cancer including but is not limited to one or more acute leukemias including but not limited to B-cell acute lymphoid leukemia (BALL), T-cell acute lymphoid leukemia (TALL), small lymphocytic leukemia (SLL), acute lymphoid leukemia (ALL); one or more chronic leukemias including but not limited chronic lymphocytic leukemia (CLL); additional hematologic cancers or hematologic conditions including, but not limited to mantle cell lymphoma (MCL), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, Marginal zone lymphoma, non-Hodgkin lymphoma, Hodgkin lymphoma, plasmablastic lymphoma, plasmacytoid dendritic cell neoplasm, Waldenstrom macroglobulinemia, and to disease associated with CD22 expression include, but not limited to atypical and/or non-classical cancers, malignancies, precancerous conditions or proliferative diseases expressing CD22; and any combination thereof.

The CAR-modified cells of the present disclosure may be administered either alone, or as a pharmaceutical composition in combination with diluents and/or with other components such as IL-2 or other cytokines or cell populations.

The present disclosure also methods for inhibiting the proliferation or reducing a CD22-expressing cell population, the methods comprising contacting a population of cells comprising a CD22-expressing cell with a CD22 CAR expressing cell of the disclosure that binds to the CD22-expressing cell. In a specific aspect, the present disclosure provides methods for inhibiting the proliferation or reducing the population of cancer cells expressing CD22, the methods comprising contacting the CD22-expressing cancer cell population with a CD22 CAR expressing cell of the disclosure that binds to the CD22-expressing cell. In one aspect, the present disclosure provides methods for inhibiting the proliferation or reducing the population of cancer cells expressing CD22, the methods comprising contacting the CD22-expressing cancer cell population with a CD22 CART of the disclosure that binds to the CD22-expressing cell. In certain aspects, the CD22 CAR expressing cell of the disclosure reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for B-cell malignancy or another cancer associated with CD22-expressing cells relative to a negative control. In one aspect, the subject is a human.

The present disclosure also provides methods for preventing, treating and/or managing a disease associated with CD22-expressing cells (e.g., a hematologic cancer or atypical cancer expressing CD22), the methods comprising administering to a subject in need a CD22 CAR expressing cell of the disclosure that binds to the CD22-expressing cell. In one aspect, the subject is a human. Non-limiting examples of disorders associated with CD22-expressing cells include autoimmune diseases, (e.g., lupus, rheumatoid arthritis, multiple sclerosis autoimmune hemolytic anemia, pure red cell aplasia, idiopathic thrombocytopenic purpura, Evans syndrome, vasculitis, bullous skin disorders, type 1 diabetes mellitus, Sjogren's syndrome, anti-NMDA receptor encephalitis and Devic's disease, Graves' ophthalmopathy, and autoimmune pancreatitis), inflammatory disorders (allergy and asthma), transplantation, and cancers (such as hematological cancers or atypical cancers expressing CD22).

The present disclosure also provides methods for preventing, treating and/or managing a disease associated with CD22-expressing cells, the methods comprising administering to a subject in need a CD22 CAR expressing cell of the disclosure that binds to the CD22-expressing cell. In one aspect, the subject is a human.

The present disclosure provides methods for preventing relapse of cancer associated with CD22-expressing cells, the methods comprising administering to a subject in need thereof a CD22 CAR expressing cell of the disclosure that binds to the CD22-expressing cell. In one aspect, the methods comprise administering to the subject in need thereof an effective amount of a CD22 CAR expressing cell described herein that binds to the CD22-expressing cell in combination with an effective amount of another therapy.

In some embodiments, the CD22 expressing cell expresses CD19, CD123, FLT-3, ROR-1, CD79b, CD179b, CD79a, CD10, CD34, and/or CD20. In certain embodiments, the CD22 expressing cell expresses CD19. In some embodiments, the CD22-expressing cell does not express CD19.

In some embodiments, the subject is a non-responder to CD19 CAR therapy. In some embodiments, the subject is a partial responder to CD19 CAR therapy. In some embodiments, the subject is a complete responder to CD19 CAR therapy. In some embodiments, the subject is a non-relapser to CD19 CAR therapy. In some embodiments, the subject is a partial relapser to CD19 CAR therapy. In some embodiments, the subject is a complete relapser to CD19 CAR therapy.

In some embodiments, a cancer or other condition that was previously responsive to treatment with CD19 CAR-expressing cells does not express CD19. In some embodiments, a cancer or other condition that was previously responsive to treatment with CD19 CAR-expressing cells has a 10%, 20%, 30%, 40%, 50% or more reduction in CD19 expression levels relative to when the cancer or other condition was responsive to treatment with CD19 CAR-expressing cells. In some embodiments, a cancer or other condition that was previously responsive to treatment with CD19 CAR-expressing cells expresses CD22 and/or CD123.

In some embodiments, the CD22 CAR-expressing cell of the disclosure is administered post-relapse of a cancer or other condition previously treated with CD19 CAR-expressing cell. In some embodiments, a CD19 CAR-expressing cell and a CD22 CAR-expressing cell are administered concurrently, as described herein.

CD19 CAR T Cells for Use in Treating Multiple Myeloma

Even with current regimens of chemotherapy, targeted therapies, and autologous stem cell transplant, myeloma is considered an incurable disease. In one study (not disclosed), treatment of multiple myeloma (MM) with autologous T cells directed to CD19 with a chimeric antigen receptor (lentivirus/CD19:4-1BB:CD3zeta; also known as "CART19" or CTL019) is described. This example demonstrates that CD19-directed CAR therapies have the potential to establish deep, long-term durable remissions based on targeting the myeloma stem cell and/or tumor cells that express very low (undetectable by most methods) levels of CD19.

CAR19 T Cell Therapy for Hodgkin Lymphoma

CAR19 T cell therapy can also be used to treat Hodgkin lymphoma (HL). Hodgkin lymphoma is characterized by the presence of malignant Hodgkin Reed-Sternberg (HRS) cells that are derived from clonal germinal center B cells. There are several factors that indicate the therapeutic efficacy of CAR19 T cell therapy for HL. CD19 staining of HL tumors shows CD19-expressing (CD19$^+$) cells within the tumor and tumor microenvironment. A study has shown that a clonal B cell population (CD20$^+$CD27$^+$ALDH$^+$) that expresses CD19 is responsible for the generation and maintenance of Hodgkin lymphoma cell lines, and also circulates in the blood of most HL patients (Jones et al., Blood, 2009, 113(23):5920-5926). This clonal B cell population has also been suggested to give rise to or contribute to the generation of the malignant HRS cells. Thus, CART19 therapy would deplete this B cell population that contributes to tumorigenesis or maintenance of tumor cells. Another study showed that B cell depletion retards solid tumor growth in multiple murine models (Kim et al., J Immunotherapy, 2008, 31(5):446-57). In support of the idea that depletion of B cells in the HL tumor microenvironment results in some anti-tumor effect, current therapies, such as rituxan, are being clinically tested for targeting and depletion of tumoral B cells in HL (Younes et al., Blood, 2012, 119(18):4123-8). De novo carcinogenesis related to chronic inflammation has also been shown to be B-cell dependent (de Visser, et al., Cancer Cell, 2005, 7(5):411-23). The results from these studies indicate that targeting of the B cell population, particularly in the HL tumor microenvironment, would be useful for treating HL, by reducing or inhibiting disease progression or tumor growth.

Non-Responder Subset of CLL Patients Exhibit Increased Expression of Immune Checkpoint Inhibitor Molecules In one study (data not published), CART19 cells from clinical manufacture from 34 CLL patients were assessed for expression of immune checkpoint inhibitor molecules, such as PD-1, LAG3, and TIM3. The response of this cohort to CART19 was known and hence a correlation between response and biomarker expression patterns could be assessed.

Effects of mTOR Inhibition on Immunosenescence in the Elderly

The efficacy of mTOR inhibition on immunosenescence is described, e.g., in Example 1 of International Application WO/2015/073644, and the entirety of the application is herein incorporated by reference.

Enhancement of Immune Response to Vaccine in Elderly Subjects

The efficacy of mTOR inhibition on enhancing an immune response is described, e.g., in Example 2 of International Application WO/2015/073644, and the entirety of the application is herein incorporated by reference.

Low dose mTOR inhibition increases energy and exercise;

The effect of mTOR inhibition on energy and exercise is described, e.g., in Example 3 of 20 International Application WO/2015/073644, and the entirety of the application is herein incorporated by reference.

P70 S6 Kinase Inhibition with RAD001

The effect of mTOR inhibition on P70 S6 kinase inhibition is described, e.g., in Example 4 of International Application WO/2015/073644, and the entirety of the application is herein incorporated by reference.

Exogenous IL-7 Enhances the Function of CAR T Cells

After adoptive transfer of CAR T cells, some patients experience limited persistence of the CAR T cells, which can result in suboptimal levels of anti-tumor activity. In this example, the effects of administration of exogenous human IL-7 is assessed in mouse xenograft models where an initial suboptimal response to CAR T cells has been observed.

Combination Therapies

A CAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In some embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

The CAR therapy and/or other therapeutic agents, procedures or modalities can be administered during periods of active disorder, or during a period of remission or less active disease. The CAR therapy can be administered before the other treatment, concurrently with the treatment, post-treatment, or during remission of the disorder.

When administered in combination, the CAR therapy and the additional agent (e.g., second or third agent), or all, can be administered in an amount or dose that is higher, lower or the same than the amount or dosage of each agent used individually, e.g., as a monotherapy. In certain embodiments, the administered amount or dosage of the CAR therapy, the additional agent (e.g., second or third agent), or all, is lower (e.g., at least 20%, at least 30%, at least 40%, or at least 50%) than the amount or dosage of each agent used individually, e.g., as a monotherapy. In some embodiments, the amount or dosage of the CAR therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In further aspects, a CAR-expressing cell described herein may be used in a treatment regimen in combination with surgery, cytokines, radiation, or chemotherapy such as cytoxan, fludarabine, histone deacetylase inhibitors, demethylating agents, or peptide vaccine, such as that described in Izumoto et al. 2008 J Neurosurg 108:963-971.

In certain instances, compounds of the present invention are combined with other therapeutic agents, such as other anti-cancer agents, anti-allergic agents, anti-nausea agents (or anti-emetics), pain relievers, cytoprotective agents, and combinations thereof.

General Chemotherapeutic agents considered for use in combination therapies include anastrozole (ARIMIDEX®), bicalutamide (CASODEX®), bleomycin sulfate (BLENOXANE®), busulfan (MYLERAN®), busulfan injection (BUSULFEX®), capecitabine (XELODA®), N4-pentoxycarbonyl-5-deoxy-5-fluorocytidine, carboplatin (PARAPLATIN®), carmustine (BICNU®), chlorambucil (LEUKERAN®), cisplatin (PLATINOL®), cladribine (LEUSTATIN®), cyclophosphamide (CYTOXAN® or NEOSAR®), cytarabine, cytosine arabinoside (CYTOSAR-U®), cytarabine liposome injection (DEPOCYT®), dacarbazine (DTIC-DOME®), dactinomycin (Actinomycin D, Cosmegan), daunorubicin hydrochloride (CERUBIDINE®), daunorubicin citrate liposome injection (DAUNOXOME®), dexamethasone, docetaxel (TAXOTERE®), doxorubicin hydrochloride (ADRIAMYCIN®, RUBEX®), etoposide (VEPESID®), fludarabine phosphate (FLUDARA®), 5-fluorouracil (ADRUCIL®, EFUDEX®), flutamide (EULEXIN®), tezacitibine, Gemcitabine (difluorodeoxycitidine), hydroxyurea (HYDREA®), Idarubicin (IDAMYCIN®), ifosfamide (IFEX®), irinotecan (CAMPTOSAR®), L-asparaginase (ELSPAR®), leucovorin calcium, melphalan (ALKERAN®), 6-mercaptopurine (PURINETHOL®), methotrexate (FOLEX®), mitoxantrone (NOVANTRONE®), mylotarg, paclitaxel (TAXOL®), nab-paclitaxel (ABRAXANE®), phoenix (Yttrium90/MX-DTPA), pentostatin, polifeprosan 20 with carmustine implant (GLIADEL®), tamoxifen citrate (NOLVADEX®), teniposide (VUMON®), 6-thioguanine, thiotepa, tirapazamine (TIRAZONE®), topotecan hydrochloride for injection (HYCAMPTIN®), vinblastine (VELBAN®), vincristine (ONCOVIN®), and vinorelbine (NAVELBINE®).

Anti-cancer agents of particular interest for combinations with the compounds of the present invention include: anti-tumor antibiotics; tyrosine kinase inhibitors; alkylating agents; anti-microtubule or anti-mitotic agents; or oncolytic viruses.

Exemplary tyrosine kinase inhibitors include but are not limited to Erlotinib hydrochloride (TARCEVA®); Linifanib (N-[4-(3-amino-1H-indazol-4-yl)phenyl]-N'-(2-fluoro-5-methylphenyl)urea, also known as ABT 869, available from Genentech); Sunitinib malate (SUTENT®); Bosutinib (4-[(2,4-dichloro-5-methoxyphenyl)amino]-6-methoxy-7-[3-(4-methylpiperazin-1-yl)propoxy]quinoline-3-carbonitrile, also known as SKI-606, and described in U.S. Pat. No. 6,780,996); Dasatinib (SPRYCEL®); Pazopanib (VOTRIENT®); Sorafenib (NEXAVAR®); Zactima (ZD6474); and Imatinib or Imatinib mesylate (GILVEC® and GLEEVEC®).

Exemplary alkylating agents include, without limitation, Oxaliplatin (ELOXATIN®); Temozolomide (TEMODAR® and TEMODAL®); Dactinomycin (also known as actinomycin-D, COSMEGEN®); Melphalan (also known as L-PAM, L-sarcolysin, and phenylalanine mustard, ALKERAN®); Altretamine (also known as hexamethylmelamine (HMM), HEXALEN®); Carmustine (BICNU®); Bendamustine (TREANDA®); Busulfan (BUSULFEX® and MYLERAN®); Carboplatin (PARAPLATIN®); Lomustine (also known as CCNU, CEENU®); Cisplatin (also known as CDDP, PLATINOL® and PLATINOL®-AQ); Chlorambucil (LEUKERAN®); Cyclophosphamide (CYTOXAN® and NEOSAR®); Dacarbazine (also known as DTIC, DIC and imidazole carboxamide, DTIC-DOME®); Altretamine (also known as hexamethylmelamine (HMM), HEXALEN®); Ifosfamide (IFEX®); Prednumustine; Procarbazine (MATULANE®); Mechlorethamine (also known as nitrogen mustard, mustine and mechloroethamine hydrochloride, MUSTARGEN®); Streptozocin (ZANOSAR®); Thiotepa (also known as thiophosphoamide, TESPA and TSPA, THIOPLEX®); Cyclophosphamide (ENDOXAN®, CYTOXAN®, NEOSAR®, PROCYTOX®, REVIMMUNE®); and Bendamustine HCl (TREANDA®).

Exemplary anti-tumor antibiotics include, e.g., Doxorubicin (ADRIAMYCIN® and RUBEX®); Bleomycin (LENOXANE®); Daunorubicin (dauorubicin hydrochloride, daunomycin, and rubidomycin hydrochloride, CERUBIDINE®); Daunorubicin liposomal (daunorubicin citrate liposome, DAUNOXOME®); Mitoxantrone (DHAD, NOVANTRONE®); Epirubicin (ELLENCE™); Idarubicin (IDAMYCIN®, IDAMYCIN PFS®); Mitomycin C (MUTAMYCIN®); Geldanamycin; Herbimycin; Ravidomycin; and Desacetylravidomycin.

Exemplary anti-microtubule or anti-mitotic agents include, without limitation, Vinca Alkaloids (such as Vinorelbine tartrate (NAVELBINE®), Vincristine (ONCOVIN®), and Vindesine (ELDISINE®); Taxanes (such as paclitaxel and docetaxel); and Estramustine (EMCYL® or ESTRACYT®).

In some embodiments, a CAR-expressing cell described herein is administered in combination with an oncolytic virus. In embodiments, oncolytic viruses are capable of selectively replicating in and triggering the death of or slowing the growth of a cancer cell. In some cases, oncolytic viruses have no effect or a minimal effect on non-cancer cells. An oncolytic virus includes but is not limited to an oncolytic adenovirus, oncolytic Herpes Simplex Viruses, oncolytic retrovirus, oncolytic parvovirus, oncolytic vaccinia virus, oncolytic Sinbis virus, oncolytic influenza virus, or oncolytic RNA virus (e.g., oncolytic reovirus, oncolytic Newcastle Disease Virus (NDV), oncolytic measles virus, or oncolytic vesicular stomatitis virus (VSV)).

In some embodiments, the oncolytic virus is a virus, e.g., recombinant oncolytic virus, described in US2010/0178684 A1, which is incorporated herein by reference in its entirety. In some embodiments, a recombinant oncolytic virus comprises a nucleic acid sequence (e.g., heterologous nucleic acid sequence) encoding an inhibitor of an immune or inflammatory response, e.g., as described in US2010/0178684 A1, incorporated herein by reference in its entirety. In embodiments, the recombinant oncolytic virus, e.g., oncolytic NDV, comprises a pro-apoptotic protein (e.g., apoptin), a cytokine (e.g., GM-CSF, interferon-gamma, interleukin-2 (IL-2), tumor necrosis factor-alpha), an immunoglobulin (e.g., an antibody against ED-B fibronectin), tumor associated antigen, a bispecific adapter protein (e.g., bispecific antibody or antibody fragment directed against NDV HN protein and a T cell co-stimulatory receptor, such as CD3 or CD28; or fusion protein between human IL-2 and single chain antibody directed against NDV HN protein). See, e.g., Zamarin et al. Future Microbiol. 7.3 (2012):347-67, incorporated herein by reference in its entirety. In some embodiments, the oncolytic virus is a chimeric oncolytic NDV described in U.S. Pat. No. 8,591,881 B2, US 2012/0122185 A1, or US 2014/0271677 A1, each of which is incorporated herein by reference in their entireties.

In some embodiments, the oncolytic virus comprises a conditionally replicative adenovirus (CRAd), which is designed to replicate exclusively in cancer cells. See, e.g., Alemany et al. Nature Biotechnol. 18(2000):723-27. In some embodiments, an oncolytic adenovirus comprises one described in Table 1 on page 725 of Alemany et al., incorporated herein by reference in its entirety.

Exemplary oncolytic viruses include but are not limited to the following:

Group B Oncolytic Adenovirus (ColoAd1) (PsiOxus Therapeutics Ltd.) (see, e.g., Clinical Trial Identifier: NCT02053220);

ONCOS-102 (previously called CGTG-102), which is an adenovirus comprising granulocyte-macrophage colony stimulating factor (GM-CSF) (Oncos Therapeutics) (see, e.g., Clinical Trial Identifier: NCT01598129);

VCN-01, which is a genetically modified oncolytic human adenovirus encoding human PH20 hyaluronidase (VCN Biosciences, S. L.) (see, e.g., Clinical Trial Identifiers: NCT02045602 and NCT02045589);

Conditionally Replicative Adenovirus ICOVIR-5, which is a virus derived from wild-type human adenovirus serotype 5 (Had5) that has been modified to selectively replicate in cancer cells with a deregulated retinoblastoma/E2F pathway (Institut Catalá d'Oncologia) (see, e.g., Clinical Trial Identifier: NCT01864759);

Celyvir, which comprises bone marrow-derived autologous mesenchymal stem cells (MSCs) infected with ICOVIR5, an oncolytic adenovirus (Hospital Infantil Universitario Niño Jesus, Madrid, Spain/Ramon Alemany) (see, e.g., Clinical Trial Identifier: NCT01844661);

CG0070, which is a conditionally replicating oncolytic serotype 5 adenovirus (Ad5) in which human E2F-1 promoter drives expression of the essential E1a viral genes, thereby restricting viral replication and cytotoxicity to Rb pathway-defective tumor cells (Cold Genesys, Inc.) (see, e.g., Clinical Trial Identifier: NCT02143804); or DNX-2401 (formerly named Delta-24-RGD), which is an adenovirus that has been engineered to replicate selectively in retinoblastoma (Rb)-pathway deficient cells and to infect cells that express certain RGD-binding integrins more efficiently (Clinica Universidad de Navarra, Universidad de Navarra/DNAtrix, Inc.) (see, e.g., Clinical Trial Identifier: NCT01956734).

In some embodiments, an oncolytic virus described herein is administering by injection, e.g., subcutaneous, intraarterial, intravenous, intramuscular, intrathecal, or intraperitoneal injection. In embodiments, an oncolytic virus described herein is administered intratumorally, transdermally, transmucosally, orally, intranasally, or via pulmonary administration.

In some embodiments, a CAR-expressing cell described herein is administered in combination with (e.g., prior to, simultaneously with, and/or subsequent to) a second CD20 inhibitor, e.g., a CD20 antibody or a CD20 antibody drug conjugate.

Exemplary CD20 antibodies include but are not limited to Rituximab (RIUXAN® and MABTHERA®); Tositumomab (BEXXAR®); and Ofatumumab (ARZERRA®).

Exemplary CD20 antibody drug conjugates include but are not limited to Ibritumomab tiuxetan (ZEVALIN®); and Tositumomab.

In one embodiment, a CAR expressing cell described herein are administered to a subject in combination with a molecule targeting GITR and/or modulating GITR functions, such as a GITR agonist and/or a GITR antibody that depletes regulatory T cells (Tregs). In one embodiment, the GITR binding molecules and/or molecules modulating GITR functions (e.g., GITR agonist and/or Treg depleting GITR antibodies) are administered prior to the CAR-expressing cell. For example, in one embodiment, the GITR agonist can be administered prior to apheresis of the cells. In one embodiment, the subject has CLL. Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No. WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.:

WO2006/083289, PCT Publication No.: WO 2005/115451, U.S. Pat. No. 7,618,632, and PCT Publication No.: WO 2011/051726.

In one embodiment, a CAR expressing cell described herein is administered to a subject in combination with an mTOR inhibitor, e.g., an mTOR inhibitor described herein, e.g., a rapalog such as everolimus. In one embodiment, the mTOR inhibitor is administered prior to the CAR-expressing cell. For example, in one embodiment, the mTOR inhibitor can be administered prior to apheresis of the cells.

In one embodiment, a CAR expressing cell described herein is administered to a subject in combination with a GITR agonist, e.g., a GITR agonist described herein. In one embodiment, the GITR agonist is administered prior to the CAR-expressing cell, e.g., CD20 CAR-expressing cells. For example, in one embodiment, the GITR agonist can be administered prior to apheresis of the cells.

In one embodiment, a CAR expressing cell described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor.

In one embodiment, a CAR-expressing cell described herein can be used in combination with a kinase inhibitor.

In an embodiment this approach can be used to optimize the performance of CAR cells described herein in the subject. While not wishing to be bound by theory, it is believed that, in an embodiment, the performance of endogenous, non-modified immune effector cells, e.g., T cells or NK cells, is improved. While not wishing to be bound by theory, it is believed that, in an embodiment, the performance of a CD20 CAR expressing cell is improved. In some embodiments, cells, e.g., T cells or NK cells, which have, or will be engineered to express a CAR, can be treated ex vivo by contact with an amount of an mTOR inhibitor that increases the number of PD1 negative immune effector cells, e.g., T cells/NK cells or increases the ratio of PD1 negative immune effector cells, e.g., T cells/NK cells/PD1 positive immune effector cells, e.g., T cells or NK cells.

In an embodiment, administration of a low, immune enhancing, dose of an mTOR inhibitor, e.g., an allosteric inhibitor, e.g., RAD001, or a catalytic inhibitor, is initiated prior to administration of an CAR expressing cell described herein, e.g., T cells or NK cells. In an embodiment, the CAR cells are administered after a sufficient time, or sufficient dosing, of an mTOR inhibitor, such that the level of PD1 negative immune effector cells, e.g., T cells/NK cells, or the ratio of PD1 negative immune effector cells, e.g., T cells/NK cells/PD1 positive immune effector cells, e.g., T cells or NK cells, has been, at least transiently, increased.

In an embodiment, the cell, e.g., T cell or NK cell, to be engineered to express a CAR, is harvested after a sufficient time, or after sufficient dosing of the low, immune enhancing, dose of an mTOR inhibitor, such that the level of PD1 negative immune effector cells, e.g., T cells or NK cells, or the ratio of PD1 negative immune effector cells, e.g., T cells/NK cells/PD1 positive immune effector cells, e.g., T cells or NK cells, in the subject or harvested from the subject has been, at least transiently, increased.

In some embodiments, the mTOR inhibitor is administered for an amount of time sufficient to decrease the proportion of PD-1 positive T cells, increase the proportion of PD-1 negative T cells, or increase the ratio of PD-1 negative T cells/PD-1 positive T cells, in the peripheral blood of the subject, or in a preparation of T cells isolated from the subject.

In some embodiments, the dose of an mTOR inhibitor is associated with mTOR inhibitor of at least 5 but no more than 90%, e.g., as measured by p70 S6K inhibition. In some some embodiments, the dose of an mTOR inhibitor is associated with mTOR inhibition of at least 10% but no more than 40%, e.g., as measured by p70 S6K inhibition.

In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo[3,4-d]pyrimidine. The MNK inhibitor can be, e.g., a MNK1a, MNK1b, MNK2a and/or MNK2b inhibitor. In one embodiment, the kinase inhibitor is a DGK inhibitor, e.g., a DGK inhibitor described herein, such as, e.g., DGKinh1 (D5919) or DGKinh2 (D5794). In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered.

In one embodiment, the kinase inhibitor is an mTOR inhibitor selected from temsirolimus; ridaforolimus (1R,2R,4S)-4-[(2R)-2 [(1R,9S,12S,15R,16E,18R,19R,21R, 23S, 24E,26E,28Z,30S,32S,35R)-1,18-dihydroxy-19,30-dimethoxy-15,17,21,23, 29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl) methanol (AZD8055); 2-amino-8-[trans-4-(2-hydroxyethoxy)cyclohexyl]-6-(6-methoxy-3-pyridinyl)-4-methylpyrido[2,3-d]pyrimidin-7(8H)-one (PF04691502); and N$^2$-[1,4-dioxo-4-[[4-(4-oxo-8-phenyl-4H-1-benzopyran-2-yl) morpholinium-4-yl]methoxy]butyl]-L-arginylglycyl-L-α-aspartylL-serine-(SEQ ID NO: 1103), inner salt (SF1126); and XL765.

In one embodiment, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment, the kinase inhibitor is an MNK inhibitor selected from CGP052088; 4-amino-3-(p-fluorophenylamino)-pyrazolo [3,4-d]pyrimidine (CGP57380); cercosporamide; ETC-1780445-2; and 4-amino-5-(4-fluoroanilino)-pyrazolo [3,4-d]pyrimidine.

Drugs that inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun. 73:316-321, 1991; Bierer et al., Curr. Opin. Immun. 5:763-773, 1993) can also be used. In a further aspect, the cell compositions of the present invention may be administered to a patient in conjunction with (e.g., before, simultaneously or following) bone marrow transplantation, T cell ablative therapy using chemotherapy agents such as, fludarabine, external-beam radiation therapy (XRT), cyclophosphamide, and/or antibodies such as OKT3 or CAMPATH. In one aspect, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

Some patients may experience allergic reactions to the compounds of the present invention and/or other anti-cancer agent(s) during or after administration; therefore, anti-allergic agents are often administered to minimize the risk of an allergic reaction. Suitable anti-allergic agents include corticosteroids, such as dexamethasone (e.g., DECADRON®), beclomethasone (e.g., BECLOVENT®), hydrocortisone (also known as cortisone, hydrocortisone sodium succinate, hydrocortisone sodium phosphate, and sold under the tradenames ALA-CORT®, hydrocortisone phosphate, SOLU-CORTEF®, HYDROCORT ACETATE® and LANA-CORT®), prednisolone (sold under the tradenames DELTA-CORTEL®, ORAPRED®, PEDIAPRED® and PRELONE®), prednisone (sold under the tradenames DEL-TASONE®, LIQUID RED®, METICORTEN® and ORA-SONE®), methylprednisolone (also known as 6-methyl-prednisolone, methylprednisolone acetate, methylprednisolone sodium succinate, sold under the tradenames DURALONE®, MEDRALONE®, MEDROL®, M PREDNISOL® and SOLU-MEDROL®); antihistamines, such as diphenhydramine (e.g., BENADRYL®), hydroxyzine, and cyproheptadine; and bronchodilators, such as the beta-adrenergic receptor agonists, albuterol (e.g., PROVENTIL®), and terbutaline (BRETHINE®).

Some patients may experience nausea during and after administration of the compound of the present invention and/or other anti-cancer agent(s); therefore, anti-emetics are used in preventing nausea (upper stomach) and vomiting. Suitable anti-emetics include aprepitant (EMEND®), ondansetron (ZOFRAN®), granisetron HCl (KYTRIL®), lorazepam (ATIVAN®. dexamethasone (DECADRON®), prochlorperazine (COMPAZINE®), casopitant (RE-ZONIC® and ZUNRISA®), and combinations thereof.

Medication to alleviate the pain experienced during the treatment period is often prescribed to make the patient more comfortable. Common over-the-counter analgesics, such Tylenol®, are often used. However, opioid analgesic drugs such as hydrocodone/paracetamol or hydrocodone/acetaminophen (e.g., VICODIN®), morphine (e.g., ASTRAMORPH® or AVINZA®), oxycodone (e.g., OXY-CONTIN® or PERCOCET®), oxymorphone hydrochloride (OPANA®), and fentanyl (e.g., DURAGESIC®) are also useful for moderate or severe pain.

In an effort to protect normal cells from treatment toxicity and to limit organ toxicities, cytoprotective agents (such as neuroprotectants, free-radical scavengers, cardioprotectors, anthracycline extravasation neutralizers, nutrients and the like) may be used as an adjunct therapy. Suitable cytoprotective agents include Amifostine (ETHYOL®), glutamine, dimesna (TAVOCEPT®), mesna (MESNEX®), dexrazoxane (ZINECARD® or TOTECT®), xaliproden (XAP-RILA®), and leucovorin (also known as calcium leucovorin, citrovorum factor and folinic acid).

The structure of the active compounds identified by code numbers, generic or trade names may be taken from the actual edition of the standard compendium "The Merck Index" or from databases, e.g. Patents International (e.g. IMS World Publications).

The above-mentioned compounds, which can be used in combination with a compound of the present invention, can be prepared and administered as described in the art, such as in the documents cited above.

In one embodiment, the present invention provides pharmaceutical compositions comprising at least one compound of the present invention (e.g., a compound of the present invention) or a pharmaceutically acceptable salt thereof together with a pharmaceutically acceptable carrier suitable for administration to a human or animal subject, either alone or together with other anti-cancer agents.

In one embodiment, the present invention provides methods of treating human or animal subjects suffering from a cellular proliferative disease, such as cancer. The present invention provides methods of treating a human or animal subject in need of such treatment, comprising administering to the subject a therapeutically effective amount of a compound of the present invention (e.g., a compound of the present invention) or a pharmaceutically acceptable salt thereof, either alone or in combination with other anti-cancer agents.

In particular, compositions will either be formulated together as a combination therapeutic or administered separately.

In combination therapy, the compound of the present invention and other anti-cancer agent(s) may be administered either simultaneously, concurrently or sequentially with no specific time limits, wherein such administration provides therapeutically effective levels of the two compounds in the body of the patient.

In a preferred embodiment, the compound of the present invention and the other anti-cancer agent(s) is generally administered sequentially in any order by infusion or orally. The dosing regimen may vary depending upon the stage of the disease, physical fitness of the patient, safety profiles of the individual drugs, and tolerance of the individual drugs, as well as other criteria well-known to the attending physician and medical practitioner(s) administering the combination. The compound of the present invention and other anti-cancer agent(s) may be administered within minutes of each other, hours, days, or even weeks apart depending upon the particular cycle being used for treatment. In addition, the cycle could include administration of one drug more often than the other during the treatment cycle and at different doses per administration of the drug.

In another aspect of the present invention, kits that include one or more compound of the present invention and a combination partner as disclosed herein are provided. Representative kits include (a) a compound of the present invention or a pharmaceutically acceptable salt thereof, (b) at least one combination partner, e.g., as indicated above, whereby such kit may comprise a package insert or other labeling including directions for administration.

A compound of the present invention may also be used to advantage in combination with known therapeutic processes, for example, the administration of hormones or especially radiation. A compound of the present invention may in particular be used as a radiosensitizers, especially for the treatment of tumors which exhibit poor sensitivity to radiotherapy.

In one embodiment, the subject can be administered an agent which reduces or ameliorates a side effect associated with the administration of a CAR-expressing cell. Side effects associated with the administration of a CAR-expressing cell include, but are not limited to CRS, and hemophagocytic lymphohistiocytosis (HLH), also termed Macrophage Activation Syndrome (MAS). Symptoms of CRS include high fevers, nausea, transient hypotension, hypoxia, and the like. CRS may include clinical constitutional signs and symptoms such as fever, fatigue, anorexia, myalgias, arthalgias, nausea, vomiting, and headache. CRS may include clinical skin signs and symptoms such as rash. CRS may include clinical gastrointestinal signs and symptoms such as nausea, vomiting and diarrhea. CRS may include clinical respiratory signs and symptoms such as tachypnea and hypoxemia. CRS may include clinical cardiovascular signs and symptoms such as tachycardia, widened pulse pressure, hypotension, increased cardac output (early) and potentially diminished cardiac output (late). CRS may include clinical coagulation signs and symptoms such as elevated d-dimer, hypofibrinogenemia with or without bleeding. CRS may include clinical renal signs and symptoms such as azotemia. CRS may include clinical hepatic signs and symptoms such as transaminitis and hyperbilirubinemia. CRS may include clinical neurologic signs and symptoms such as headache, mental status changes, confusion, delirium, word finding difficulty or frank aphasia, hallucinations, tremor, dymetria, altered gait, and seizures. Accordingly, the methods described herein can comprise administering a CAR-expressing cell described herein to a subject and further administering one or more agents to manage elevated levels of a soluble factor resulting from treatment with a CAR-expressing cell. In one embodiment, the soluble factor elevated in the subject is one or more of IFN-γ, TNFα, IL-2 and IL-6. In an embodiment, the factor elevated in the subject is one or more of IL-1, GM-CSF, IL-10, IL-8, IL-5 and fraktalkine. Therefore, an agent administered to treat this side effect can be an agent that neutralizes one or more of these soluble factors. In one embodiment, the agent that neutralizes one or more of these soluble forms is an antibody or antigen binding fragment thereof. Examples of such agents include, but are not limited to a steroid (e.g., corticosteroid), an inhibitor of TNFα, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitor of TNFα include, but are not limited to, xanthine derivatives (e.g. pentoxifylline) and bupropion. An example of an IL-6 inhibitor is an anti-IL-6 antibody molecule such as tocilizumab (toc), sarilumab, elsilimomab, CNTO 328, ALD518/BMS-945429, CNTO 136, CPSI-2364, CDP6038, VX30, ARGX-109, FE301, and FM101. In one embodiment, the anti-IL-6 antibody molecule is tocilizumab. An example of an IL-1R based inhibitor is anakinra.

In some embodiment, the subject is administered a corticosteroid, such as, e.g., methylprednisolone, hydrocortisone, among others.

In some embodiments, the subject is administered a vasopressor, such as, e.g., norepinephrine, dopamine, phenylephrine, epinephrine, vasopressin, or a combination thereof.

In an embodiment, the subject can be administered an antipyretic agent. In an embodiment, the subject can be administered an analgesic agent.

In one embodiment, the subject can be administered an agent which enhances the activity of a CAR-expressing cell. For example, in one embodiment, the agent can be an agent which inhibits an inhibitory molecule. Inhibitory molecules, e.g., Programmed Death 1 (PD1), can, in some embodiments, decrease the ability of a CAR-expressing cell to mount an immune effector response. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGF beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, or a clustered regularly interspaced short palindromic repeats (CRISPR), a transcription-activator like effector nuclease (TALEN), or a zinc finger endonuclease (ZFN), can be used to inhibit expression of an inhibitory molecule in the CAR-expressing cell. In an embodiment the inhibitor is an shRNA. In an embodiment, the inhibitory molecule is inhibited within a CAR-expressing cell. In these embodiments, a dsRNA molecule that inhibits expression of the inhibitory molecule is linked to the nucleic acid that encodes a component, e.g., all of the components, of the CAR. In one embodiment, the inhibitor of an inhibitory signal can be, e.g., an antibody or antibody fragment that binds to an inhibitory molecule. For example, the agent can be an antibody or antibody fragment that binds to PD1, PD-L1, PD-L2 or CTLA4 (e.g., ipilimumab (also referred to as MDX-010 and MDX-101, and marketed as YERVOY®; Bristol-Myers Squibb; Tremelimumab (IgG2 monoclonal antibody available from Pfizer, formerly known as ticilimumab, CP-675,206).). In an embodiment, the agent is an antibody or antibody fragment that binds to TIM3. In an embodiment, the agent is an antibody or antibody fragment that binds to LAG3. In an embodiment, the agent is an antibody or antibody fragment that binds to CEACAM (e.g., CEACAM-1, CEACAM-3 and/or CEACAM-5).

PD1 is an inhibitory member of the CD28 family of receptors that also includes CD28, CTLA-4, ICOS, and BTLA. PD1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD1 with PD-L. Antibodies, antibody fragments, and other inhibitors of PD1, PD-L1 and PD-L2 are available in the art and may be used combination with a CD20 CAR described herein. For example, nivolumab (also referred to as BMS-936558 or MDX1106; Bristol-Myers Squibb) is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. Pidilizumab (CT-011; Cure Tech) is a humanized IgG1k monoclonal antibody that binds to PD1Pidilizumab and other humanized anti-PD1 monoclonal antibodies are disclosed in WO2009/101611. Pembrolizumab (formerly known as lambrolizumab, and also referred to as Keytruda, MK03475; Merck) is a humanized IgG4 monoclonal antibody that binds to PD1. Pembrolizumab and other humanized anti-PD1 antibodies are disclosed in U.S. Pat. No. 8,354,509 and WO2009/114335. MEDI4736 (Medimmune) is a human monoclonal antibody that binds to PDL1, and inhibits interaction of the ligand with PD1. MDPL3280A (Genentech/Roche) is a human Fc optimized IgG1 monoclonal antibody that binds to PD-L. MDPL3280A and other human monoclonal antibodies to PD-L1 are disclosed in U.S. Pat. No. 7,943,743 and U.S Publication No.: 20120039906. Other anti-PD-L1 binding agents include YW243.55.570 (heavy and light chain variable regions are shown in SEQ ID NOs: 20 and 21 in WO2010/077634) and MDX-1 105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD1 and B7-H1. Other anti-PD1 antibodies include AMP 514 (Amplimmune), among others, e.g., anti-PD1 antibodies disclosed in U.S. Pat. No. 8,609,089, US 2010028330, and/or US 20120114649.

TIM3 (T cell immunoglobulin-3) also negatively regulates T cell function, particularly in IFN-g-secreting CD4+T helper 1 and CD8+T cytotoxic 1 cells, and plays a critical role in T cell exhaustion. Inhibition of the interaction between TIM3 and its ligands, e.g., galectin-9 (Gal9), phosphotidylserine (PS), and HMGB1, can increase immune response. Antibodies, antibody fragments, and other inhibitors of TIM3 and its ligands are available in the art and may be used combination with a CAR, e.g., CD20 CAR described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In some embodiments, the agent which enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In some embodiments, the anti-CEACAM antibody binds to CEACAM-5 as described in, e.g., Zheng et al. PLoS One. 2010 Sep. 2; 5(9). pii: e12529 (DOI:10.1371/journal.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. J Immunol. 2002 Mar. 15; 168(6): 2803-10; Markel et al. J Immunol. 2006 Nov. 1; 177(9): 6062-71; Markel et al. Immunology. 2009 February; 126(2): 186-200; Markel et al. Cancer Immunol Immunother. 2010 February; 59(2):215-30; Ortenberg et al. Mol Cancer Ther. 2012 June; 11(6):1300-10; Stern et al. J Immunol. 2005 Jun. 1; 174(11):6692-701; Zheng et al. PLoS One. 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) Nature doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In some embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer an ovarian cancer, and other cancers as described herein.

LAG3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG3 and its ligands are available in the art and may be used combination with a CAR, e.g., a CD20 CAR described herein. For example, BMS-986016 (Bristol-Myers Squib) is a monoclonal antibody that targets LAG3. IMP701 (Immutep) is an antagonist LAG3 antibody and IMP731 (Immutep and GlaxoSmithKline) is a depleting LAG3 antibody. Other LAG3 inhibitors include IMP321 (Immutep), which is a recombinant fusion protein of a soluble portion of LAG3 and Ig that binds to MHC class II molecules and activates antigen presenting cells (APC). Other antibodies are disclosed, e.g., in WO2010/019570.

In some embodiments, the agent which enhances the activity of a CAR-expressing cell can be, e.g., a fusion protein comprising a first domain and a second domain, wherein the first domain is an inhibitory molecule, or fragment thereof, and the second domain is a polypeptide that is associated with a positive signal, e.g., a polypeptide comprising an intracellular signaling domain as described herein. In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the CAR. In another embodiment, the fusion protein is expressed by a cell, e.g., a T cell or NK cell that does not express a CD20 CAR.

In one embodiment, the agent which enhances activity of a CAR-expressing cell described herein is miR-17-92.

Combination with a Low Dose of an mTOR Inhibitor

In one embodiment, the cells expressing a CAR molecule, e.g., a CAR molecule described herein, are administered in combination with a low, immune enhancing dose of an mTOR inhibitor.

In an embodiment, a dose of an mTOR inhibitor is associated with, or provides, mTOR inhibition of at least 5 but no more than 90%, at least 10 but no more than 90%, at least 15, but no more than 90%, at least 20 but no more than 90%, at least 30 but no more than 90%, at least 40 but no more than 90%, at least 50 but no more than 90%, at least 60 but no more than 90%, or at least 70 but no more than 90%.

In an embodiment, a dose of an mTOR inhibitor is associated with, or provides, mTOR inhibition of at least 5 but no more than 80%, at least 10 but no more than 80%, at least 15, but no more than 80%, at least 20 but no more than 80%, at least 30 but no more than 80%, at least 40 but no more than 80%, at least 50 but no more than 80%, or at least 60 but no more than 80%.

In an embodiment, a dose of an mTOR inhibitor is associated with, or provides, mTOR inhibition of at least 5 but no more than 70%, at least 10 but no more than 70%, at least 15, but no more than 70%, at least 20 but no more than 70%, at least 30 but no more than 70%, at least 40 but no more than 70%, or at least 50 but no more than 70%.

In an embodiment, a dose of an mTOR inhibitor is associated with, or provides, mTOR inhibition of at least 5 but no more than 60%, at least 10 but no more than 60%, at least 15, but no more than 60%, at least 20 but no more than 60%, at least 30 but no more than 60%, or at least 40 but no more than 60%.

In an embodiment, a dose of an mTOR inhibitor is associated with, or provides, mTOR inhibition of at least 5 but no more than 50%, at least 10 but no more than 50%, at least 15, but no more than 50%, at least 20 but no more than 50%, at least 30 but no more than 50%, or at least 40 but no more than 50%.

In an embodiment, a dose of an mTOR inhibitor is associated with, or provides, mTOR inhibition of at least 5 but no more than 40%, at least 10 but no more than 40%, at least 15, but no more than 40%, at least 20 but no more than 40%, at least 30 but no more than 40%, or at least 35 but no more than 40%.

In an embodiment, a dose of an mTOR inhibitor is associated with, or provides, mTOR inhibition of at least 5 but no more than 30%, at least 10 but no more than 30%, at least 15, but no more than 30%, at least 20 but no more than 30%, or at least 25 but no more than 30%.

In an embodiment, a dose of an mTOR inhibitor is associated with, or provides, mTOR inhibition of at least 1, 2, 3, 4 or 5 but no more than 20%, at least 1, 2, 3, 4 or 5 but no more than 30%, at least 1, 2, 3, 4 or 5, but no more than 35, at least 1, 2, 3, 4 or 5 but no more than 40%, or at least 1, 2, 3, 4 or 5 but no more than 45%.

In an embodiment, a dose of an mTOR inhibitor is associated with, or provides, mTOR inhibition of at least 1, 2, 3, 4 or 5 but no more than 90%.

As is discussed herein, the extent of mTOR inhibition can be expressed as the extent of P70 S6 kinase inhibition, e.g., the extent of mTOR inhibition can be determined by the level of decrease in P70 S6 kinase activity, e.g., by the decrease in phosphorylation of a P70 S6 kinase substrate. The level of mTOR inhibition can be evaluated by a method described herein, e.g. by the Boulay assay, or measurement of phosphorylated S6 levels by western blot.

Exemplary mTOR Inhibitors

As used herein, the term "mTOR inhibitor" refers to a compound or ligand, or a pharmaceutically acceptable salt thereof, which inhibits the mTOR kinase in a cell. In an embodiment an mTOR inhibitor is an allosteric inhibitor. In an embodiment an mTOR inhibitor is a catalytic inhibitor.

Allosteric mTOR inhibitors include the neutral tricyclic compound rapamycin (sirolimus), rapamycin-related compounds, that is compounds having structural and functional similarity to rapamycin including, e.g., rapamycin derivatives, rapamycin analogs (also referred to as rapalogs) and other macrolide compounds that inhibit mTOR activity.

Rapamycin is a known macrolide antibiotic produced by *Streptomyces hygroscopicus* having the structure shown in Formula A.

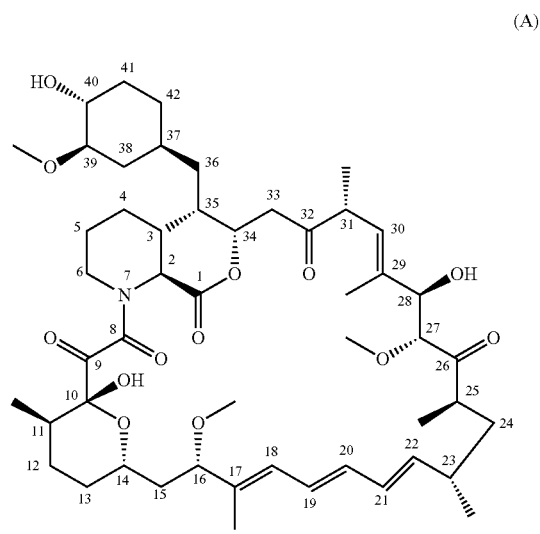 [SMILES: CO[C@H]1C[C@@H]2CC[C@@H](C)[C@@](O)(O2)C(=O)C(=O)N2CCCC[C@H]2C(=O)O[C@H]([C@H](C)C[C@@H]2CC[C@@H](O)[C@H](OC)C2)CC(=O)[C@H](C)/C=C(\C)[C@@H](O)[C@@H](OC)C(=O)[C@H](C)C[C@H](C)/C=C/C=C/C=C/1C]

(A)

See, e.g., McAlpine, J. B., et al., J. Antibiotics (1991) 44: 688; Schreiber, S. L., et al., J. Am. Chem. Soc. (1991) 113: 7433; U.S. Pat. No. 3,929,992. There are various numbering schemes proposed for rapamycin. To avoid confusion, when specific rapamycin analogs are named herein, the names are given with reference to rapamycin using the numbering scheme of formula A.

Rapamycin analogs useful in the invention are, for example, O-substituted analogs in which the hydroxyl group on the cyclohexyl ring of rapamycin is replaced by $OR_1$ in which $R_1$ is hydroxyalkyl, hydroxyalkoxyalkyl, acylaminoalkyl, or aminoalkyl; e.g. RAD001, also known as, everolimus as described in U.S. Pat. No. 5,665,772 and WO94/09010 the contents of which are incorporated by reference. Other suitable rapamycin analogs include those substituted at the 26- or 28-position. The rapamycin analog may be an epimer of an analog mentioned above, particularly an epimer of an analog substituted in position 40, 28 or 26, and may optionally be further hydrogenated, e.g. as described in U.S. Pat. No. 6,015,815, WO95/14023 and WO99/15530 the contents of which are incorporated by reference, e.g. ABT578 also known as zotarolimus or a rapamycin analog described in U.S. Pat. No. 7,091,213, WO98/02441 and WO01/14387 the contents of which are incorporated by reference, e.g. AP23573 also known as ridaforolimus.

Examples of rapamycin analogs suitable for use in the present invention from U.S. Pat. No. 5,665,772 include, but are not limited to, 40-O-benzyl-rapamycin, 40-O-(4'-hydroxymethyl)benzyl-rapamycin, 40-O-[4'-(1,2-dihydroxyethyl)]benzyl-rapamycin, 40-O-allyl-rapamycin, 40-O-[3'-(2,2-dimethyl-1,3-dioxolan-4(S)-yl)-prop-2'-en-1'-yl]-rapamycin, (2'E,4'S)-40-O-(4',5'-dihydroxypent-2'-en-1'-yl)-rapamycin, 40-O-(2-hydroxy)ethoxycarbonylmethyl-rapamycin, 40-O-(2-hydroxy)ethyl-rapamycin, 40-O-(3-hydroxy)propyl-rapamycin, 40-O-(6-hydroxy)hexyl-rapamycin, 40-O-[2-(2-hydroxy)ethoxy]ethyl-rapamycin, 40-O-[(3S)-2,2-dimethyldioxolan-3-yl]methyl-rapamycin, 40-O-[(2S)-2,3-dihydroxyprop-1-yl]-rapamycin, 40-O-(2-acetoxy)ethyl-rapamycin, 40-O-(2-nicotinoyloxy)ethyl-rapamycin, 40-O-[2-(N-morpholino)acetoxy]ethyl-rapamycin, 40-O-(2-N-imidazolylacetoxy)ethyl-rapamycin, 40-O-[2-(N-methyl-N'-piperazinyl)acetoxy]ethyl-rapamycin, 39-O-desmethyl-39,40-O,O-ethylene-rapamycin, (26R)-26-dihydro-40-O-(2-hydroxy)ethyl-rapamycin, 40-O-(2-aminoethyl)-rapamycin, 40-O-(2-acetaminoethyl)-rapamycin, 40-O-(2-nicotinamidoethyl)-rapamycin, 40-O-(2-(N-methyl-imidazo-2'-ylcarbethoxamido)ethyl)-rapamycin, 40-O-(2-ethoxycarbonylaminoethyl)-rapamycin, 40-O-(2-tolylsulfonamidoethyl)-rapamycin and 40-O-[2-(4',5'-dicarboethoxy-1',2',3'-triazol-1'-yl)-ethyl]-rapamycin.

Other rapamycin analogs useful in the present invention are analogs where the hydroxyl group on the cyclohexyl ring of rapamycin and/or the hydroxy group at the 28 position is replaced with an hydroxyester group are known, for example, rapamycin analogs found in U.S. RE44,768, e.g. temsirolimus.

Other rapamycin analogs useful in the preset invention include those wherein the methoxy group at the 16 position is replaced with another substituent, preferably (optionally hydroxy-substituted) alkynyloxy, benzyl, orthomethoxybenzyl or chlorobenzyl and/or wherein the mexthoxy group at the 39 position is deleted together with the 39 carbon so that the cyclohexyl ring of rapamycin becomes a cyclopentyl ring lacking the 39 position methyoxy group; e.g. as described in WO95/16691 and WO96/41807 the contents of which are incorporated by reference. The analogs can be further modified such that the hydroxy at the 40-position of rapamycin is alkylated and/or the 32-carbonyl is reduced.

Rapamycin analogs from WO95/16691 include, but are not limited to, 16-demethoxy-16-(pent-2-ynyl)oxy-rapamycin, 16-demethoxy-16-(but-2-ynyl)oxy-rapamycin, 16-demethoxy-16-(propargyl)oxy-rapamycin, 16-demethoxy-16-(4-hydroxy-but-2-ynyl)oxy-rapamycin, 16-demethoxy-16-benzyloxy-40-O-(2-hydroxyethyl)-rapamycin, 16-demethoxy-16-benzyloxy-rapamycin, 16-demethoxy-16-ortho-methoxybenzyl-rapamycin, 16-demethoxy-40-O-(2-methoxyethyl)-16-pent-2-ynyl)oxy-rapamycin, 39-demethoxy-40-desoxy-39-formyl-42-nor-rapamycin, 39-demethoxy-40-desoxy-39-hydroxymethyl-42-nor-rapamycin, 39-demethoxy-40-desoxy-39-carboxy-42-nor-rapamycin, 39-demethoxy-40-desoxy-39-(4-methylpiperazin-1-yl)carbonyl-42-nor-rapamycin, 39-demethoxy-40-desoxy-39-(morpholin-4-yl)carbonyl-42-nor-rapamycin, 39-demethoxy-40-desoxy-39-[N-methyl,N-(2-pyridin-2-yl-ethyl)]carbamoyl-42-nor-rapamycin and 39-demethoxy-40-desoxy-39-(p-toluenesulfonylhydrazonomethyl)-42-nor-rapamycin.

Rapamycin analogs from WO96/41807 include, but are not limited to, 32-deoxo-rapamycin, 16-O-pent-2-ynyl-32-deoxo-rapamycin, 16-O-pent-2-ynyl-32-deoxo-40-O-(2-hydroxy-ethyl)-rapamycin, 16-O-pent-2-ynyl-32-(S)-dihydro-40-O-(2-hydroxyethyl)-rapamycin, 32(S)-dihydro-40-O-(2-methoxy)ethyl-rapamycin and 32(S)-dihydro-40-O-(2-hydroxyethyl)-rapamycin.

Another suitable rapamycin analog is umirolimus as described in US2005/0101624 the contents of which are incorporated by reference.

RAD001, otherwise known as everolimus (AFINITOR®), has the chemical name (1R,9S,12S,15R,16E,18R,19R,21R,23S,24E,26E,28E,30S,32S,35R)-1,18-dihydroxy-12-{(1R)-2-[(1S,3R,4R)-4-(2-hydroxyethoxy)-3-methoxycyclohexyl]-1-methylethyl}-19,30-dimethoxy-15,17,21,23,29,35-hexamethyl-11,36-dioxa-4-aza-tricyclo[30.3.1.04,9]hexatriaconta-16,24,26,28-tetraene-2,3,10,14,20-pentaone.

Further examples of allosteric mTOR inhibitors include sirolimus (rapamycin, AY-22989), 40-[3-hydroxy-2-(hydroxymethyl)-2-methylpropanoate]-rapamycin (also called temsirolimus or CCI-779) and ridaforolimus (AP-23573/MK-8669). Other examples of allosteric mTor inhibitors include zotarolimus (ABT578) and umirolimus.

Alternatively or additionally, catalytic, ATP-competitive mTOR inhibitors have been found to target the mTOR kinase domain directly and target both mTORC1 and mTORC2. These are also more effective inhibitors of mTORC1 than such allosteric mTOR inhibitors as rapamycin, because they modulate rapamycin-resistant mTORC1 outputs such as 4EBP1-T37/46 phosphorylation and cap-dependent translation.

Catalytic inhibitors include: BEZ235 or 2-methyl-2-[4-(3-methyl-2-oxo-8-quinolin-3-yl-2,3-dihydro-imidazo[4,5-c]quinolin-1-yl)-phenyl]-propionitrile, or the monotosylate salt form. the synthesis of BEZ235 is described in WO2006/122806; CCG168 (otherwise known as AZD-8055, Chresta, C. M., et al., Cancer Res, 2010, 70(1), 288-298) which has the chemical name {5-[2,4-bis-((S)-3-methyl-morpholin-4-yl)-pyrido[2,3d]pyrimidin-7-yl]-2-methoxy-phenyl}-methanol; 3-[2,4-bis[(3S)-3-methylmorpholin-4-yl]pyrido[2,3-d]pyrimidin-7-yl]-N-methylbenzamide (WO09104019); 3-(2-aminobenzo[d]oxazol-5-yl)-1-isopropyl-1H-pyrazolo[3,4-d]pyrimidin-4-amine (WO10051043 and WO2013023184); A N-(3-(N-(3-((3,5-dimethoxyphenyl)amino)quinoxaline-2-yl) sulfamoyl)phenyl)-3-methoxy-4-methylbenzamide (WO07044729 and WO12006552); PKI-587 (Venkatesan, A. M., J. Med. Chem., 2010, 53, 2636-2645) which has the chemical name 1-[4-[4-(dimethylamino)piperidine-1-carbonyl]phenyl]-3-[4-(4,6-dimorpholino-1,3,5-triazin-2-yl)phenyl]urea; GSK-2126458 (ACS Med. Chem. Lett., 2010, 1, 39-43) which has the chemical name 2,4-difluoro-N-{2-methoxy-5-[4-(4-pyridazinyl)-6-quinolinyl]-3-pyridinyl}benzenesulfonamide; 5-(9-isopropyl-8-methyl-2-morpholino-9H-purin-6-yl)pyrimidin-2-amine (WO10114484); (E)-N-(8-(6-amino-5-(trifluoromethyl) pyridin-3-yl)-1-(6-(2-cyanopropan-2-yl)pyridin-3-yl)-3-methyl-H-imidazo[4,5-c]quinolin-2(3H)-ylidene)cyanamide (WO12007926).

Further examples of catalytic mTOR inhibitors include 8-(6-methoxy-pyridin-3-yl)-3-methyl-1-(4-piperazin-1-yl-3-trifluoromethyl-phenyl)-1,3-dihydro-imidazo[4,5-c]quinolin-2-one (WO2006/122806) and Ku-0063794 (Garcia-Martinez J M, et al., Biochem J., 2009, 421(1), 29-42. Ku-0063794 is a specific inhibitor of the mammalian target of rapamycin (mTOR).) WYE-354 is another example of a catalytic mTor inhibitor (Yu K, et al. (2009). Biochemical, Cellular, and In vivo Activity of Novel ATP-Competitive and Selective Inhibitors of the Mammalian Target of Rapamycin. Cancer Res. 69(15): 6232-6240).

mTOR inhibitors useful according to the present invention also include prodrugs, derivatives, pharmaceutically acceptable salts, or analogs thereof of any of the foregoing.

mTOR inhibitors, such as RAD001, may be formulated for delivery based on well-established methods in the art based on the particular dosages described herein. In particular, U.S. Pat. No. 6,004,973 (incorporated herein by reference) provides examples of formulations useable with the mTOR inhibitors described herein.

Evaluation of mTOR Inhibition mTOR phosphorylates the kinase P70 S6, thereby activating P70 S6 kinase and allowing it to phosphorylate its substrate. The extent of mTOR inhibition can be expressed as the extent of P70 S6 kinase inhibition, e.g., the extent of mTOR inhibition can be determined by the level of decrease in P70 S6 kinase activity, e.g., by the decrease in phosphorylation of a P70 S6 kinase substrate. One can determine the level of mTOR inhibition, by measuring P70 S6 kinase activity (the ability of P70 S6 kinase to phosphorylate a substrate), in the absence of inhibitor, e.g., prior to administration of inhibitor, and in the presence of inhibitor, or after the administration of inhibitor. The level of inhibition of P70 S6 kinase gives the level of mTOR inhibition. Thus, if P70 S6 kinase is inhibited by 40%, mTOR activity, as measured by P70 S6 kinase activity, is inhibited by 40%. The extent or level of inhibition referred to herein is the average level of inhibition over the dosage interval. By way of example, if the inhibitor is given once per week, the level of inhibition is given by the average level of inhibition over that interval, namely a week.

Boulay et al., Cancer Res, 2004, 64:252-61, hereby incorporated by reference, teaches an assay that can be used to assess the level of mTOR inhibition (referred to herein as the Boulay assay). In an embodiment, the assay relies on the measurement of P70 S6 kinase activity from biological samples before and after administration of an mTOR inhibitor, e.g., RAD001. Samples can be taken at preselected times after treatment with an mTOR inhibitor, e.g., 24, 48, and 72 hours after treatment. Biological samples, e.g., from skin or peripheral blood mononuclear cells (PBMCs) can be used. Total protein extracts are prepared from the samples. P70 S6 kinase is isolated from the protein extracts by immunoprecipitation using an antibody that specifically recognizes the P70 S6 kinase. Activity of the isolated P70 S6 kinase can be measured in an in vitro kinase assay. The isolated kinase can be incubated with 40S ribosomal subunit substrates (which is an endogenous substrate of P70 S6 kinase) and gamma-$^{32}$P under conditions that allow phosphorylation of the substrate. Then the reaction mixture can be resolved on an SDS-PAGE gel, and $^{32}$P signal analyzed using a PhosphorImager. A $^{32}$P signal corresponding to the size of the 40S ribosomal subunit indicates phosphorylated substrate and the activity of P70 S6 kinase. Increases and decreases in kinase activity can be calculated by quantifying the area and intensity of the $^{32}$P signal of the phosphorylated substrate (e.g., using ImageQuant, Molecular Dynamics), assigning arbitrary unit values to the quantified signal, and comparing the values from after administration with values from before administration or with a reference value. For example, percent inhibition of kinase activity can be calculated with the following formula: 1-(value obtained after administration/value obtained before administration)×100. As described above, the extent or level of inhibition referred to herein is the average level of inhibition over the dosage interval.

Methods for the evaluation of kinase activity, e.g., P70 S6 kinase activity, are also provided in U.S. Pat. No. 7,727,950, hereby incorporated by reference.

The level of mTOR inhibition can also be evaluated by a change in the ration of PD1 negative to PD1 positive T cells. T cells from peripheral blood can be identified as PD1 negative or positive by art-known methods.

Low-Dose mTOR Inhibitors

Methods described herein use low, immune enhancing, dose mTOR inhibitors, doses of mTOR inhibitors, e.g., allosteric mTOR inhibitors, including rapalogs such as RAD001. In contrast, levels of inhibitor that fully or near fully inhibit the mTOR pathway are immunosuppressive and are used, e.g., to prevent organ transplant rejection. In addition, high doses of rapalogs that fully inhibit mTOR also inhibit tumor cell growth and are used to treat a variety of cancers (See, e.g., Antineoplastic effects of mammalian target of rapamycine inhibitors. Salvadori M. World J Transplant. 2012 Oct. 24; 2(5):74-83; Current and Future Treatment Strategies for Patients with Advanced Hepatocellular Carcinoma: Role of mTOR Inhibition. Finn R S. Liver Cancer. 2012 November; 1(3-4):247-256; Emerging Signaling Pathways in Hepatocellular Carcinoma. Moeini A, Cornella H, Villanueva A. Liver Cancer. 2012 September; 1(2):83-93; Targeted cancer therapy—Are the days of systemic chemotherapy numbered?Joo W D, Visintin I, Mor G. Maturitas. 2013 September 20; Role of natural and adaptive immunity in renal cell carcinoma response to VEGFR-TKIs and mTOR inhibitor. Santoni M, Berardi R, Amantini C, Burattini L, Santini D, Santoni G, Cascinu S. Int J Cancer. 2013 Oct. 2).

The present invention is based, at least in part, on the surprising finding that doses of mTOR inhibitors well below those used in current clinical settings had a superior effect in increasing an immune response in a subject and increasing the ratio of PD-1 negative T cells/PD-1 positive T cells. It was surprising that low doses of mTOR inhibitors, producing only partial inhibition of mTOR activity, were able to effectively improve immune responses in human subjects and increase the ratio of PD-1 negative T cells/PD-1 positive T cells.

Alternatively, or in addition, without wishing to be bound by any theory, it is believed that low, a low, immune enhancing, dose of an mTOR inhibitor can increase naive T cell numbers, e.g., at least transiently, e.g., as compared to a non-treated subject. Alternatively or additionally, again while not wishing to be bound by theory, it is believed that treatment with an mTOR inhibitor after a sufficient amount of time or sufficient dosing results in one or more of the following:

an increase in the expression of one or more of the following markers: $CD62L^{high}CD127^{high}$, $CD27^+$, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased $CD62L^{high}$, increased $CD127^{high}$ increased $CD27^+$, decreased KLRG1, and increased BCL2; and wherein any of the changes described above occurs, e.g., at least transiently, e.g., as compared to a non-treated subject (Araki, K et al. (2009) *Nature* 460:108-112). Memory T cell precursors are memory T cells that are early in the differentiation program. For example, memory T cells have one or more of the following characteristics: increased $CD62L^{high}$ increased $CD127^{high}$, increased $CD27^+$, decreased KLRG1, and/or increased BCL2.

In an embodiment, the invention relates to a composition, or dosage form, of an mTOR inhibitor, e.g., an allosteric mTOR inhibitor, e.g., a rapalog, rapamycin, or RAD001, or a catalytic mTOR inhibitor, which, when administered on a selected dosing regimen, e.g., once daily or once weekly, is associated with: a level of mTOR inhibition that is not associated with complete, or significant immune suppression, but is associated with enhancement of the immune response.

An mTOR inhibitor, e.g., an allosteric mTOR inhibitor, e.g., a rapalog, rapamycin, or RAD001, or a catalytic mTOR inhibitor, can be provided in a sustained release formulation. Any of the compositions or unit dosage forms described herein can be provided in a sustained release formulation. In some embodiments, a sustained release formulation will have lower bioavailability than an immediate release formulation. E.g., in embodiments, to attain a similar therapeutic effect of an immediate release formation a sustained release formulation will have from about 2 to about 5, about 2.5 to about 3.5, or about 3 times the amount of inhibitor provided in the immediate release formulation.

In an embodiment, immediate release forms, e.g., of RAD001, typically used for one administration per week, having 0.1 to 20, 0.5 to 10, 2.5 to 7.5, 3 to 6, or about 5, mgs per unit dosage form, are provided. For once per week administrations, these immediate release formulations correspond to sustained release forms, having, respectively, 0.3 to 60, 1.5 to 30, 7.5 to 22.5, 9 to 18, or about 15 mgs of an mTOR inhibitor, e.g., an allosteric mTOR inhibitor, e.g., rapamycin or RAD001. In embodiments both forms are administered on a once/week basis.

In an embodiment, immediate release forms, e.g., of RAD001, typically used for one administration per day, having 0.005 to 1.5, 0.01 to 1.5, 0.1 to 1.5, 0.2 to 1.5, 0.3 to 1.5, 0.4 to 1.5, 0.5 to 1.5, 0.6 to 1.5, 0.7 to 1.5, 0.8 to 1.5, 1.0 to 1.5, 0.3 to 0.6, or about 0.5 mgs per unit dosage form, are provided. For once per day administrations, these immediate release forms correspond to sustained release forms, having, respectively, 0.015 to 4.5, 0.03 to 4.5, 0.3 to 4.5, 0.6 to 4.5, 0.9 to 4.5, 1.2 to 4.5, 1.5 to 4.5, 1.8 to 4.5, 2.1 to 4.5, 2.4 to 4.5, 3.0 to 4.5, 0.9 to 1.8, or about 1.5 mgs of an mTOR inhibitor, e.g., an allosteric mTOR inhibitor, e.g., rapamycin or RAD001. For once per week administrations, these immediate release forms correspond to sustained release forms, having, respectively, 0.1 to 30, 0.2 to 30, 2 to 30, 4 to 30, 6 to 30, 8 to 30, 10 to 30, 1.2 to 30, 14 to 30, 16 to 30, 20 to 30, 6 to 12, or about 10 mgs of an mTOR inhibitor, e.g., an allosteric mTOR inhibitor, e.g., rapamycin or RAD001.

In an embodiment, immediate release forms, e.g., of RAD001, typically used for one administration per day, having 0.01 to 1.0 mgs per unit dosage form, are provided. For once per day administrations, these immediate release forms correspond to sustained release forms, having, respectively, 0.03 to 3 mgs of an mTOR inhibitor, e.g., an allosteric mTOR inhibitor, e.g., rapamycin or RAD001. For once per week administrations, these immediate release forms correspond to sustained release forms, having, respectively, 0.2 to 20 mgs of an mTOR inhibitor, e.g., an allosteric mTOR inhibitor, e.g., rapamycin or RAD001.

In an embodiment, immediate release forms, e.g., of RAD001, typically used for one administration per week, having 0.5 to 5.0 mgs per unit dosage form, are provided. For once per week administrations, these immediate release forms correspond to sustained release forms, having, respectively, 1.5 to 15 mgs of an mTOR inhibitor, e.g., an allosteric mTOR inhibitor, e.g., rapamycin or RAD001.

As described above, one target of the mTOR pathway is the P70 S6 kinase. Thus, doses of mTOR inhibitors which are useful in the methods and compositions described herein are those which are sufficient to achieve no greater than 80% inhibition of P70 S6 kinase activity relative to the activity of the P70 S6 kinase in the absence of an mTOR inhibitor, e.g., as measured by an assay described herein, e.g., the Boulay assay. In a further aspect, the invention provides an amount of an mTOR inhibitor sufficient to achieve no greater than 38% inhibition of P70 S6 kinase activity relative to P70 S6 kinase activity in the absence of an mTOR inhibitor.

In one aspect the dose of mTOR inhibitor useful in the methods and compositions of the invention is sufficient to achieve, e.g., when administered to a human subject, 90+/−5% (i.e., 85-95%), 89+/−5%, 88+/−5%, 87+/−5%, 86+/−5%, 85+/−5%, 84+/−5%, 83+/−5%, 82+/−5%, 81+/−5%, 80+/−5%, 79+/−5%, 78+/−5%, 77+/−5%, 76+/−5%, 75+/−5%, 74+/−5%, 73+/−5%, 72+/−5%, 71+/−5%, 70+/−5%, 69+/−5%, 68+/−5%, 67+/−5%, 66+/−5%, 65+/−5%, 64+/−5%, 63+/−5%, 62+/−5%, 61+/−5%, 60+/−5%, 59+/−5%, 58+/−5%, 57+/−5%, 56+/−5%, 55+/−5%, 54+/−5%, 54+/−5%, 53+/−5%, 52+/−5%, 51+/−5%, 50+/−5%, 49+/−5%, 48+/−5%, 47+/−5%, 46+/−5%, 45+/−5%, 44+/−5%, 43+/−5%, 42+/−5%, 41+/−5%, 40+/−5%, 39+/−5%, 38+/−5%, 37+/−5%, 36+/−5%, 35+/−5%, 34+/−5%, 33+/−5%, 32+/−5%, 31+/−5%, 30+/−5%, 29+/−5%, 28+/−5%, 27+/−5%, 26+/−5%, 25+/−5%, 24+/−5%, 23+/−5%, 22+/−5%, 21+/−5%, 20+/−5%, 19+/−5%, 18+/−5%, 17+/−5%, 16+/−5%, 15+/−5%, 14+/−5%, 13+/−5%, 12+/−5%, 11+/−5%, or 10+/−5%, inhibition of P70 S6 kinase activity, e.g., as measured by an assay described herein, e.g., the Boulay assay.

P70 S6 kinase activity in a subject may be measured using methods known in the art, such as, for example, according to the methods described in U.S. Pat. No. 7,727,950, by immunoblot analysis of phosphoP70 S6K levels and/or phosphoP70 S6 levels or by in vitro kinase activity assays.

As used herein, the term "about" in reference to a dose of mTOR inhibitor refers to up to a +/−10% variability in the amount of mTOR inhibitor, but can include no variability around the stated dose.

In some embodiments, the invention provides methods comprising administering to a subject an mTOR inhibitor, e.g., an allosteric inhibitor, e.g., RAD001, at a dosage within a target trough level. In some embodiments, the trough level is significantly lower than trough levels associated with dosing regimens used in organ transplant and cancer patients. In an embodiment mTOR inhibitor, e.g., RAD001, or rapamycin, is administered to result in a trough level that is less than ½, ¼, ⅒, or ¹⁄₂₀ of the trough level that results in immunosuppression or an anticancer effect. In an embodiment mTOR inhibitor, e.g., RAD001, or rapamycin, is administered to result in a trough level that is less than ½, ¼, ⅒, or ¹⁄₂₀ of the trough level provided on the FDA approved packaging insert for use in immunosuppression or an anticancer indications.

In an embodiment a method disclosed herein comprises administering to a subject an mTOR inhibitor, e.g., an allosteric inhibitor, e.g., RAD001, at a dosage that provides a target trough level of 0.1 to 10 ng/ml, 0.1 to 5 ng/ml, 0.1 to 3 ng/ml, 0.1 to 2 ng/ml, or 0.1 to 1 ng/ml.

In an embodiment a method disclosed herein comprises administering to a subject an mTOR inhibitor, e.g., an allosteric inhibitor, e.g., RAD001, at a dosage that provides a target trough level of 0.2 to 10 ng/ml, 0.2 to 5 ng/ml, 0.2 to 3 ng/ml, 0.2 to 2 ng/ml, or 0.2 to 1 ng/ml.

In an embodiment a method disclosed herein comprises administering to a subject an mTOR inhibitor, e.g. an, allosteric inhibitor, e.g., RAD001, at a dosage that provides a target trough level of 0.3 to 10 ng/ml, 0.3 to 5 ng/ml, 0.3 to 3 ng/ml, 0.3 to 2 ng/ml, or 0.3 to 1 ng/ml.

In an embodiment a method disclosed herein comprises administering to a subject an mTOR inhibitor, e.g., an allosteric inhibitor, e.g., RAD001, at a dosage that provides a target trough level of 0.4 to 10 ng/ml, 0.4 to 5 ng/ml, 0.4 to 3 ng/ml, 0.4 to 2 ng/ml, or 0.4 to 1 ng/ml.

In an embodiment a method disclosed herein comprises administering to a subject an mTOR inhibitor, e.g., an allosteric inhibitor, e.g., RAD001, at a dosage that provides a target trough level of 0.5 to 10 ng/ml, 0.5 to 5 ng/ml, 0.5 to 3 ng/ml, 0.5 to 2 ng/ml, or 0.5 to 1 ng/ml.

In an embodiment a method disclosed herein comprises administering to a subject an mTOR inhibitor, e.g., an allosteric inhibitor, e.g., RAD001, at a dosage that provides a target trough level of 1 to 10 ng/ml, 1 to 5 ng/ml, 1 to 3 ng/ml, or 1 to 2 ng/ml.

As used herein, the term "trough level" refers to the concentration of a drug in plasma just before the next dose, or the minimum drug concentration between two doses.

In some embodiments, a target trough level of RAD001 is in a range of between about 0.1 and 4.9 ng/ml. In an embodiment, the target trough level is below 3 ng/ml, e.g., is between 0.3 or less and 3 ng/ml. In an embodiment, the target trough level is below 3 ng/ml, e.g., is between 0.3 or less and 1 ng/ml.

In a further aspect, the invention can utilize an mTOR inhibitor other than RAD001 in an amount that is associated with a target trough level that is bioequivalent to the specified target trough level for RAD001. In an embodiment, the target trough level for an mTOR inhibitor other than RAD001, is a level that gives the same level of mTOR inhibition (e.g., as measured by a method described herein, e.g., the inhibition of P70 S6) as does a trough level of RAD001 described herein.

Pharmaceutical Compositions: mTOR Inhibitors

In one aspect, the present invention relates to pharmaceutical compositions comprising an mTOR inhibitor, e.g., an mTOR inhibitor as described herein, formulated for use in combination with CAR cells described herein.

In some embodiments, the mTOR inhibitor is formulated for administration in combination with an additional, e.g., as described herein.

In general, compounds of the invention will be administered in therapeutically effective amounts as described above via any of the usual and acceptable modes known in the art, either singly or in combination with one or more therapeutic agents.

The pharmaceutical formulations may be prepared using conventional dissolution and mixing procedures. For example, the bulk drug substance (e.g., an mTOR inhibitor or stabilized form of the compound (e.g., complex with a cyclodextrin derivative or other known complexation agent) is dissolved in a suitable solvent in the presence of one or more of the excipients described herein. The mTOR inhibitor is typically formulated into pharmaceutical dosage forms to provide an easily controllable dosage of the drug and to give the patient an elegant and easily handleable product.

Compounds of the invention can be administered as pharmaceutical compositions by any conventional route, in particular enterally, e.g., orally, e.g., in the form of tablets or capsules, or parenterally, e.g., in the form of injectable solutions or suspensions, topically, e.g., in the form of lotions, gels, ointments or creams, or in a nasal or suppository form. Where an mTOR inhibitor is administered in combination with (either simultaneously with or separately from) another agent as described herein, in one aspect, both components can be administered by the same route (e.g., parenterally). Alternatively, another agent may be administered by a different route relative to the mTOR inhibitor. For example, an mTOR inhibitor may be administered orally and the other agent may be administered parenterally.

Sustained Release mTOR inhibitors, e.g., allosteric mTOR inhibitors or catalytic mTOR inhibitors, disclosed herein can be provided as pharmaceutical formulations in form of oral solid dosage forms comprising an mTOR inhibitor disclosed herein, e.g., rapamycin or RAD001, which satisfy product stability requirements and/or have favorable pharmacokinetic properties over the immediate release (IR) tablets, such as reduced average plasma peak concentrations, reduced inter- and intra-patient variability in the extent of drug absorption and in the plasma peak concentration, reduced $C_{max}/C_{min}$ ratio and/or reduced food effects. Provided pharmaceutical formulations may allow for more precise dose adjustment and/or reduce frequency of adverse events thus providing safer treatments for patients with an mTOR inhibitor disclosed herein, e.g., rapamycin or RAD001.

In some embodiments, the present disclosure provides stable extended release formulations of an mTOR inhibitor disclosed herein, e.g., rapamycin or RAD001, which are multi-particulate systems and may have functional layers and coatings.

The term "extended release, multi-particulate formulation as used herein refers to a formulation which enables release of an mTOR inhibitor disclosed herein, e.g., rapamycin or RAD001, over an extended period of time e.g. over at least 1, 2, 3, 4, 5 or 6 hours. The extended release formulation may contain matrices and coatings made of special excipients, e.g., as described herein, which are formulated in a manner as to make the active ingredient available over an extended period of time following ingestion.

The term "extended release" can be interchangeably used with the terms "sustained release" (SR) or "prolonged release". The term "extended release" relates to a pharmaceutical formulation that does not release active drug substance immediately after oral dosing but over an extended in accordance with the definition in the pharmacopoeias Ph. Eur. ($7^{th}$ edition) monograph for tablets and capsules and USP general chapter <1151> for pharmaceutical dosage forms. The term "Immediate Release" (IR) as used herein refers to a pharmaceutical formulation which releases 85% of the active drug substance within less than 60 minutes in accordance with the definition of "Guidance for Industry: "Dissolution Testing of Immediate Release Solid Oral Dosage Forms" (FDA CDER, 1997). In some embodiments, the term "immediate release" means release of a drug, e.g., an mTOR inhibitor, e.g., everolimus from tablets within the time of 30 minutes, e.g., as measured in the dissolution assay described herein.

Stable extended release formulations of an mTOR inhibitor disclosed herein, e.g., rapamycin or RAD001, can be characterized by an in-vitro release profile using assays known in the art, such as a dissolution assay as described herein: a dissolution vessel filled with 900 mL phosphate buffer pH 6.8 containing sodium dodecyl sulfate 0.2% at 37° C. and the dissolution is performed using a paddle method at 75 rpm according to USP by according to USP testing monograph 711, and Ph. Eur. testing monograph 2.9.3. respectively.

In some embodiments, stable extended release formulations of an mTOR inhibitor disclosed herein, e.g., rapamycin or RAD001, release the mTOR inhibitor in the in-vitro release assay according to following release specifications:

0.5 h: <45%, or <40, e.g., <30%
1 h: 20-80%, e.g., 30-60%
2 h: >50%, or >70%, e.g., >75%
3 h: >60%, or >65%, e.g., >85%, e.g., >90%.

In some embodiments, stable extended release formulations of an mTOR inhibitor disclosed herein, e.g., rapamycin or RAD001, release 50% of the mTOR inhibitor not earlier than 45, 60, 75, 90, 105 min or 120 min in the in-vitro dissolution assay.

ROR1 Inhibitors

Also provided herein are ROR1 inhibitors and combination therapies, e.g., combinations of a CD20 CAR-expressing cell described herein with a ROR1 inhibitor. ROR1 inhibitors include but are not limited to anti-ROR1 CAR-expressing cells, e.g. CARTs, and anti-ROR antibodies (e.g., an anti-ROR1 mono- or bispecific antibody) and fragments thereof. In some embodiments, anti-ROR1 inhibitors can be used to treat a disease described herein.

An exemplary anti-ROR1 inhibitor is described in Hudecek, et al. Clin. Cancer Res. 19.12 (2013):3153-64, incorporated herein by reference. For example, an anti-ROR1 inhibitor includes the anti-ROR1 CARTs described in Hudecek et al. (for example, generated as described in Hudecek et al. at page 3155, first full paragraph, incorporated herein by reference). In other examples, an anti-ROR1 inhibitor includes an antibody or fragment thereof comprising the VH and/or VL sequences of the 2A2 and R12 anti-ROR1 monoclonal antibodies described in Hudecek et al. at paragraph bridging pages 3154-55; Baskar et al. MAbs 4(2012):349-61; and Yang et al. PLoS ONE 6(2011):e21018, incorporated herein by reference.

In some embodiments, a ROR1 inhibitor includes an antibody or fragment thereof (e.g., single chain variable fragment (scFv)) that targets ROR1, including those described in US 2013/0101607, e.g., SEQ ID NOs: 1 or 2 of US 2013/0101607, incorporated herein by reference. In some embodiments, anti-ROR1 antibody fragments (e.g., scFvs) are conjugated or fused to a biologically active molecule, e.g., to form a chimeric antigen receptor (CAR) that directs immune cells, e.g., T cells or NK cells, to respond to ROR1-expressing cells.

In some embodiments, an exemplary ROR1 inhibitor includes an anti-ROR1 monoclonal antibody called UC-961 (Cirmtuzumab). See, e.g., Clinical Trial Identifier No. NCT02222688. Cirmtuzumab can be used to treat cancers, such as chronic lymphocytic leukemia (CLL), ovarian cancer, and melanoma. See, e.g., Hojjat-Farsangi et al. PLoS One. 8(4): e61167; and NCT02222688.

In some embodiments, cirmtuzumab is administered intravenously, e.g., as an intravenous infusion. For example, each infusion provides about 700-7000 µg (e.g., 700-750, 750-800, 800-850, 850-900, 900-950, 950-1000, 1000-1500, 1500-2000, 2000-2500, 2500-3000, 3000-3500, 3500-4000, 4000-4500, 4500-5000, 5000-5500, 5500-6000, 6000-6500, or 6500-7000 µg) of cirmtuzumab. In some embodiments, cirmtuzumab is administered at a dose of 10-100 µg/kg body weight, e.g., 10-15, 15-20, 20-25, 25-30, 30-35, 35-40, 40-45, 45-50, 50-55, 55-60, 60-65, 65-70, 70-75, 75-80, 80-85, 85-90, 90-95, or 95-100 µg/kg body weight. In one embodiment, cirmtuzumab is administered at a starting dose of 15 µg/kg body weight.

In some embodiments, cirmtuzumab is administered at a dosing interval of at least 7 days, e.g., 7, 14, 21, 28, 35 days, or more. For example, cirmtuzumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, cirmtuzumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, cirmtuzumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some embodiments, the anti-ROR1 antibody is conjugated or otherwise bound to a therapeutic agent.

In some embodiments, a ROR1 inhibitor includes an anti-ROR1 CAR-expressing cell, e.g., CART, e.g., a cell expressing an anti-ROR1 CAR construct or encoded by a ROR1 binding CAR comprising a scFv, CDRs, or VH and VL chains. For example, an anti-ROR1 CAR-expressing cell, e.g., CART is a generated by engineering a ROR1-CAR (that comprises a ROR1 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD20 CARs and ROR1 CARs. For example, in one embodiment, the population of CAR-expressing cell can include a first cell expressing a CD20 CAR and a second cell expressing a ROR1 CAR. In one embodiment, the population of CAR-expressing cells includes, e.g., a first cell expressing a CAR (e.g., a CD19 CAR, a ROR1 CAR, a CD20 CAR, or a CD22 CAR) that includes a primary intracellular signaling domain, and a second cell expressing a CAR (e.g., a CD19 CAR, a ROR1 CAR, a CD20 CAR, or a CD22 CAR)) that includes a secondary signaling domain.

CD22 Inhibitors

Provided herein are CD22 inhibitors and combination therapies, e.g., combinations of CD22 inhibitors with a CAR-expressing cell described herein (e.g., a CD20 CAR-expressing cell described herein).

In one embodiment, the CD22 inhibitor is a CD22 inhibitor described herein. The CD22 inhibitor can be, e.g., an anti-CD22 antibody (e.g., an anti-CD22 mono- or bispecific antibody) or a CD22 CART, such as described in Table 6. In some embodiments the anti-CD22 antibody is conjugated or otherwise bound to a therapeutic agent. Exemplary therapeutic agents include, e.g., microtubule disrupting agents (e.g., monomethyl auristatin E) and toxins (e.g., diphtheria toxin or Pseudomonas exotoxin-A, ricin).

In an embodiment, the anti-CD22 antibody is an anti-CD22 monoclonal antibody-MMAE conjugate (e.g., DCDT2980S). In an embodiment, the antibody is a scFv of an anti-CD22 antibody, e.g., a scFv of antibody RFB4. This scFv can be fused to all of or a fragment of Pseudomonas exotoxin-A (e.g., BL22). In an embodiment, the antibody is a humanized anti-CD22 monoclonal antibody (e.g., epratuzumab). In an embodiment, the antibody or fragment thereof comprises the Fv portion of an anti-CD22 antibody, which is optionally covalently fused to all or a fragment or (e.g., a 38 KDa fragment of) Pseudomonas exotoxin-A (e.g., moxetumomab pasudotox). In an embodiment, the anti-CD22 antibody is an anti-CD19/CD22 bispecific antibody, optionally conjugated to a toxin. For instance, in one embodiment, the anti-CD22 antibody comprises an anti-CD19/CD22 bispecific portion, (e.g., two scFv ligands, recognizing human CD19 and CD22) optionally linked to all of or a portion of diphtheria toxin (DT), e.g., first 389 amino acids of diphtheria toxin (DT), DT 390, e.g., a ligand-directed toxin such as DT2219ARL). In another embodiment, the bispecific portion (e.g., anti-CD19/anti-CD22) is linked to a toxin such as deglycosylated ricin A chain (e.g., Combotox).

In one embodiment, the anti-CD22 antibody is selected from an anti-CD19/CD22 bispecific ligand-directed toxin (e.g., two scFv ligands, recognizing human CD19 and CD22, linked to the first 389 amino acids of diphtheria toxin (DT), DT 390, e.g., DT2219ARL); anti-CD22 monoclonal antibody-MMAE conjugate (e.g., DCDT2980S); scFv of an anti-CD22 antibody RFB4 fused to a fragment of Pseudomonas exotoxin-A (e.g., BL22); deglycosylated ricin A chain-conjugated anti-CD19/anti-CD22 (e.g., Combotox); humanized anti-CD22 monoclonal antibody (e.g., epratuzumab); or the Fv portion of an anti-CD22 antibody covalently fused to a 38 KDa fragment of Pseudomonas exotoxin-A (e.g., moxetumomab pasudotox).

In one embodiment, the anti-CD22 antibody is an anti-CD19/CD22 bispecific ligand-directed toxin (e.g., DT2219ARL) and the anti-CD19/CD22 bispecific ligand-directed toxin is administered at a dose of about 1 µg/kg, 2 µg/kg, 3 µg/kg, 4 µg/kg, 5 µg/kg, 6 µg/kg, 7 µg/kg, 8 µg/kg, 9 µg/kg, 10 µg/kg, 11 µg/kg, 12 µg/kg, 13 µg/kg, 14 µg/kg, 15 µg/kg, 20 µg/kg, 25 µg/kg, 30 µg/kg, 40 µg/kg, 60 µg/kg, 80 µg/kg, 100 µg/kg, 120 µg/kg, 140 µg/kg, 160 µg/kg, 180 µg/kg, 200 µg/kg, 220 µg/kg, 250 µg/kg, 300 µg/kg, 350 µg/kg, 400 µg/kg, 450 µg/kg, 500 µg/kg, 600 µg/kg, 700 µg/kg, 800 µg/kg, 900 µg/kg, 1 mg·kg (e.g., 30 µg/kg, 40 µg/kg, 60 µg/kg, or 80 µg/kg) for a period of time, e.g., every 1, 2, 3, 4, 5, 6, 7, 8, 9, 10, 11, 12 or more days. In some embodiments, the anti-CD19/CD22 bispecific ligand-directed toxin is administered via intravenous infusion.

In one embodiment, the anti-CD22 antibody is BL22 and BL22 is administered at a dose of about 1 µg/kg, 2 µg/kg, 3 µg/kg, 4 µg/kg, 5 µg/kg, 6 µg/kg, 7 µg/kg, 8 µg/kg, 9 µg/kg, 10 µg/kg, 11 µg/kg, 12 µg/kg, 13 µg/kg, 14 µg/kg, 15 µg/kg, 20 µg/kg, 25 µg/kg, 30 µg/kg, 40 µg/kg, 60 µg/kg, 80 µg/kg, 100 µg/kg, 120 µg/kg, 140 µg/kg, 160 µg/kg, 180 µg/kg, 200 µg/kg, 220 µg/kg, 250 µg/kg, 300 µg/kg, 350 µg/kg, 400 µg/kg, 450 µg/kg, 500 µg/kg, 600 µg/kg, 700 µg/kg, 800 µg/kg, 900 µg/kg, 1 mg·kg (e.g., 3 µg/kg, 30 µg/kg, 40 µg/kg, or 50 µg/kg) for a period of time, e.g., every 1, 2, 3, 4, 5, 6, 7, 8, 9, 10, 11, 12 or more days. In some embodiments, BL22 is administered daily, every other day, every third, day, or every fourth day for a period of time, e.g., for a 4 day cycle, a 6 day cycle, an 8 day cycle, a 10 day cycle, a 12 day cycle, or a 14 day cycle. In one embodiment, 1, 2, 3, 4, 5, 6, 7, 8, 9, 10, 11, 12 or more cycles of BL22 are administered. In some embodiments, BL22 is administered via intravenous infusion.

In one embodiment, the anti-CD22 antibody is a deglycosylated ricin A chain-conjugated anti-CD19/anti-CD22 (e.g., Combotox) and the deglycosylated ricin A chain-conjugated anti-CD19/anti-CD22 is administered at a dose of about 500 µg/m$^2$, 600 µg/m$^2$, 700 g/m$^2$, 800 µg/m$^2$, 900 µg/m$^2$, 1 mg/m$^2$, 2 mg/m$^2$, 3 mg/m$^2$, 4 mg/m$^2$, 5 mg/m$^2$, 6 mg/m$^2$, or 7 mg/m$^2$ for a period of time, e.g., every 1, 2, 3, 4, 5, 6, 7, 8, 9, 10, 11, 12 or more days. In some embodiments, the deglycosylated ricin A chain-conjugated anti-CD19/anti-CD22 is administered daily, every other day, every third, day, or every fourth day for a period of time, e.g., for a 4 day cycle, a 6 day cycle, an 8 day cycle, a 10 day cycle, a 12 day cycle, or a 14 day cycle (e.g., every other day for 6 days). In one embodiment, 1, 2, 3, 4, 5, 6, 7, 8, 9, 10, 11, 12 or more cycles of the deglycosylated ricin A chain-conjugated anti-CD19/anti-CD22 are administered. In some embodiments, the deglycosylated ricin A chain-conjugated anti-CD19/anti-CD22 is administered via intravenous infusion.

In one embodiment, the anti-CD22 antibody is a humanized anti-CD22 monoclonal antibody (e.g., epratuzumab) and the humanized anti-CD22 monoclonal antibody is administered at a dose of about 10 mg/m$^2$/week, 20 mg/m$^2$/week, 50 mg/m$^2$/week, 100 mg/m$^2$/week, 120 mg/m$^2$/week, 140 mg/m$^2$/week, 160 mg/m$^2$/week, 180 mg/m$^2$/week, 200 mg/m$^2$/week, 220 mg/m$^2$/week, 250 mg/m$^2$/week, 260 mg/m$^2$/week, 270 mg/m$^2$/week, 280 mg/m$^2$/week, 290 mg/m$^2$/week, 300 mg/m$^2$/week, 305 mg/m$^2$/week, 310 mg/m$^2$/week, 320 mg/m$^2$/week, 325 mg/m$^2$/week, 330 mg/m$^2$/week, 335 mg/m$^2$/week, 340 mg/m$^2$/week, 345 mg/m$^2$/week, 350 mg/m$^2$/week, 355 mg/m$^2$/week, 360 mg/m$^2$/week, 365 mg/m$^2$/week, 370 mg/m$^2$/week, 375 mg/m$^2$/week, 380 mg/m$^2$/week, 385 mg/m$^2$/week, 390 mg/m$^2$/week, 400 mg/m$^2$/week, 410 mg/m$^2$/week, 420 mg/m$^2$/week, 430 mg/m$^2$/week, 440 mg/m$^2$/week, 450 mg/m$^2$/week, 460 mg/m$^2$/week, 470 mg/m$^2$/week, 480 mg/m$^2$/week, 490 mg/m$^2$/week, 500 mg/m$^2$/week, 600 mg/m$^2$/week, 700 mg/m$^2$/week, 800 mg/m$^2$/week, 900 mg/m$^2$/week, 1 g/m$^2$/week, or 2 g/m$^2$/week (e.g., 360 mg/m$^2$/week or 480 mg/m$^2$/week) for a period of time, e.g., every 1, 2, 3, 4, 5, 6, 7, 8, 9, 10, 11, 12 or more weeks. In some embodiments a first dose is lower than subsequent doses (e.g. a first dose of 360 mg/m$^2$/week followed by subsequent doses of 370 mg/m$^2$/week). In some embodiments, the humanized anti-CD22 monoclonal antibody is administered via intravenous infusion.

In one embodiment, the anti-CD22 antibody is moxetumomab pasudotox and moxetumomab pasudotox is administered at a dose of about 1 µg/kg, 2 µg/kg, 3 µg/kg, 4 g/kg, 5 µg/kg, 6 µg/kg, 7 µg/kg, 8 µg/kg, 9 µg/kg, 10 µg/kg, 11 µg/kg, 12 µg/kg, 13 µg/kg, 14 g/kg, 15 µg/kg, 20 µg/kg, 25 µg/kg, 30 µg/kg, 40 µg/kg, 60 µg/kg, 80 µg/kg, 100 µg/kg, 120 g/kg, 140 µg/kg, 160 µg/kg, 180 µg/kg, 200 µg/kg, 220 µg/kg, 250 µg/kg, 300 µg/kg, 350 g/kg, 400 µg/kg, 450 µg/kg, 500 µg/kg (e.g., 5 µg/kg, 10 µg/kg, 20 µg/kg, 30 µg/kg, 40 g/kg, or 50 µg/kg) a period of time, e.g., every 1, 2, 3, 4, 5, 6, 7, 8, 9, 10, 11, 12 or more days. In some embodiments, the moxetumomab pasudotox is administered daily, every other day, every third, day, or every fourth day for a period of time, e.g., for a 4 day cycle, a 6 day cycle, an 8 day cycle, a 10 day cycle, a 12 day cycle, or a 14 day cycle (e.g., every other day for 6 days). In one embodiment, 1, 2, 3, 4, 5, 6, 7, 8, 9, 10, 11, 12 or more cycles of the moxetumomab pasudotox are administered. In some embodiments, the moxetumomab pasudotox is administered via intravenous infusion.

In one embodiment, the CD22 inhibitor includes a CD22 CAR-expressing cell, e.g., a CD22 CART, or e.g., a CD22-CAR that comprises a CD22 binding domain and is engineered into a cell (e.g., T cell or NK cell) for administration in combination with CD20 CART, and methods of their use for adoptive therapy. In some embodiments, the CD22 inhibitor includes a cell expressing a CD22 CAR construct or encoded by a CD22 CAR comprising a scFv, CDRs, or VH and VL chains. For example, a CD22 CAR-expressing cell, e.g., CART, is generated by engineering a CD22-CAR (that comprises a CD22 binding domain) into a cell (e.g., a T cell or NK cell), e.g., for administration in combination with a CAR-expressing cell described herein, e.g., a CD20 CART described herein.

In another aspect, the present invention provides a population of CAR-expressing cells, e.g., CAR-expressing cell, comprising a mixture of cells expressing CD20 CARs and CD22 CARs. For example, in one embodiment, the population of CAR-expressing cell can include a first cell expressing a CD20 CAR and a second cell expressing a CD22 CAR. In one embodiment, the population of CAR-expressing cells includes, e.g., a first cell expressing a CAR (e.g., a CD20 CAR or CD22 CAR) that includes a primary intracellular signaling domain, and a second cell expressing a CAR (e.g., a CD20 CAR or CD22 CAR) that includes a secondary signaling domain. In one embodiment, CD20 CAR comprise or consist of sequences according to Table 1. In one embodiment, CD22 CAR comprise or consist of sequences according to Table 6.

CD19 Inhibitors

Provided herein are CD19 inhibitors and combination therapies, e.g., combinations of CD19 inhibitors with a CAR-expressing cell described herein (e.g., a CD20 CAR-expressing cell described herein or a CD22 CAR-expressing cell described herein). A CD19 inhibitor includes but is not limited to a CD19 CAR-expressing cell, e.g., a CD19 CAR-expressing cell, or an anti-CD19 antibody (e.g., an anti-CD19 mono- or bispecific antibody, which may comprise or consist of sequences according to Table 11) or a fragment or conjugate thereof. In an embodiment, the CD19 inhibitor is administered in combination with a CD20, CD22, or ROR1 inhibitor, e.g., a CD20, CD22, or ROR1 CAR-expressing cell, e.g., a CAR-expressing cell described herein.

Exemplary anti-CD19 antibodies or fragments or conjugates thereof include but are not limited to blinatumomab, SAR3419 (Sanofi), MEDI-551 (MedImmune LLC), Combotox, DT2219ARL (Masonic Cancer Center), MOR-208 (also called XmAb-5574; MorphoSys), XmAb-5871 (Xencor), MDX-1342 (Bristol-Myers Squibb), SGN-CD19A (Seattle Genetics), and AFM11 (Affimed Therapeutics). See, e.g., Hammer. MAbs. 4.5 (2012): 571-77.

In some aspects, the anti-CD19 antibody or fragment or conjugate thereof comprises blinatomomab. Blinatomomab is a bispecific antibody comprised of two scFvs-one that binds to CD19 and one that binds to CD3. Blinatomomab directs T cells to attack cancer cells. See, e.g., Hammer et al.; Clinical Trial Identifier No. NCT00274742 and NCT01209286. In some embodiments, blinatomomab can be used to treat NHL (e.g., DLBCL) or ALL.

In some embodiments, blinatomomab is administered intravenously, e.g., as an intravenous infusion. In some embodiments, blinatomomab is administered at a dose of about 0.5 to 120 μg/m²/24 hours, e.g., about 0.5-1 μg/m²/24 hours, 1-5 μg/m²/24 hours, 5-15 μg/m²/24 hours, 15-30 μg/m²/24 hours, 30-60 μg/m²/24 hours, or 60-120 μg/m²/24 hours.

In some embodiments, blinatomomab is administered at a dosing interval of at least 4 days, e.g., 4, 7, 14, 21, 28, 35 days, or more. For example, blinatomomab is administered at a dosing interval of at least 0.5 weeks, e.g., 0.5, 1, 2, 3, 4, 5, 6, 7, 8 weeks, or more. In some embodiments, blinatomomab is administered via a continuous intravenous infusion over 2-8 weeks per cycle, e.g., over 2-3, 3-4, 4-5, 5-6, 6-7, or 7-8 weeks per cycle.

In some embodiments, blinatomomab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20 weeks, or greater. For example, blinatomomab is administered at a dose and dosing interval described herein for a total of at least 4 doses per treatment cycle (e.g., at least 4, 5, 6, 7, 8, 9, 10, 11, 12, 13, 14, 15, 16, or more doses per treatment cycle).

In some aspects, the anti-CD19 antibody comprises MEDI-551. MEDI-551 is a humanized anti-CD19 antibody with a Fc engineered to have enhanced antibody-dependent cell-mediated cytotoxicity (ADCC). See, e.g., Hammer et al.; and Clinical Trial Identifier No. NCT01957579. In some embodiments, MEDI-551 can be used to treat B cell malignancies (e.g., NHL, CLL, DLBCL, and multiple myeloma), multiple sclerosis, and scleroderma.

In some embodiments, MEDI-551 is administered intravenously, e.g., as an intravenous infusion. In some cases, MEDI-551 is administered at a dose of about 0.5-12 mg/kg, e.g., 0.5-1 mg/kg, 1-2 mg/kg, 2-4 mg/kg, 4-8 mg/kg, or 8-12 mg/kg.

In some embodiments, MEDI-551 is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more. In some embodiments, MEDI-551 is administered at a dosing interval of at least 7 days, e.g., 7, 14, 21, 28, 35 days, or more.

In some embodiments, MEDI-551 is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, MEDI-551 is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some aspects, the anti-CD19 antibody or fragment or conjugate thereof comprises Combotox. Combotox is a mixture of immunotoxins that bind to CD19 and CD22. The immunotoxins are made up of scFv antibody fragments fused to a deglycosylated ricin A chain. See, e.g., Hammer et al.; and Herrera et al. J. Pediatr. Hematol. Oncol. 31.12 (2009):936-41; Schindler et al. Br. J. Haematol. 154.4 (2011):471-6. In some embodiments, Combotox can be used to treat B cell leukemia, e.g., ALL.

In some embodiments, Combotox is administered intravenously, e.g., as an intravenous infusion. In some cases, Combotox is administered at a dose of about 1-10 mg/m², e.g., about 1-2 mg/m², 2-3 mg/m², 3-4 mg/m², 4-5 mg/m², or 5-6 mg/m², 6-7 mg/m², 7-8 mg/m², 8-9 mg/m², or 9-10 mg/m².

In some embodiments, Combotox is administered at a dosing interval of at least 2 days, e.g., 2, 3, 4, 5, 6, 7, 14, 21, 28, 35 days, or more. In some embodiments, Combotox is administered at a dose and dosing interval described herein for a period of time, e.g., at least 1 week, e.g., at least 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, Combotox is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspects, the anti-CD19 antibody or fragment or conjugate thereof comprises DT2219ARL. DT2219ARL is a bispecific immunotoxin targeting CD19 and CD22, comprising two scFvs and a truncated diphtheria toxin. See, e.g., Hammer et al.; and Clinical Trial Identifier No. NCT00889408. In some embodiments, DT2219ARL can be used to treat B cell malignancies, e.g., B cell leukemias and lymphomas.

In some embodiments, DT2219ARL is administered intravenously, e.g., as an intravenous infusion. In some embodiments, DT2219ARL is administered at a dose of about 20-100 µg/kg, e.g., about 20-40 µg/kg, 40-60 µg/kg, 60-80 µg/kg, or 80-100 µg/kg.

In some embodiments, DT2219ARL is administered at a dosing interval of at least 2 days, e.g., 2, 3, 4, 5, 6, 7, 14, 21, 28, 35 days, or more. In some embodiments, DT2219ARL is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, DT2219ARL is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspects, the anti-CD19 antibody or fragment or conjugate thereof comprises SGN-CD19A. SGN-CD19A is an antibody-drug conjugate (ADC) comprised of an anti-CD19 humanized monoclonal antibody linked to a synthetic cytotoxic cell-killing agent, monomethyl auristatin F (MMAF). See, e.g., Hammer et al.; and Clinical Trial Identifier Nos. NCT01786096 and NCT01786135. In some embodiments, SGN-CD19A can be used to treat B-cell ALL, NHL (e.g., DLBCL, mantle cell lymphoma, or follicular lymphoma), Burkitt lymphoma or leukemia, or B-lineage lymphoblastic lymphoma (B-LBL).

In some embodiments, SGN-CD19A is administered intravenously, e.g., as an intravenous infusion. In some embodiments, SGN-CD19A is administered at a dose of about 0.1-10 mg/kg, e.g., about 0.1-0.3 mg/kg, 0.3-0.6 mg/kg, 0.6-1 mg/kg, 1-2 mg/kg, 2-3 mg/kg, 3-4 mg/kg, 4-5 mg/kg, 5-6 mg/kg, 6-7 mg/kg, 7-8 mg/kg, 8-9 mg/kg, or 9-10 mg/kg.

In some embodiments, SGN-CD19A is administered at a dosing interval of at least 7 days, e.g., 7, 14, 21, 28, 35 days, or more. For example, SGN-CD19A is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, SGN-CD19A is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, SGN-CD19A is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspects, the anti-CD19 antibody comprises MOR-208 (also called XmAb-5574). MOR-208 is an Fc-engineered anti-CD19 humanized monoclonal antibody with enhanced FcγRIIIA binding, which results in improved ADCC activity. See, e.g., ClinicalTrials.gov Identifier Nos. NCT01685008, NCT01685021, NCT02005289, and NCT01161511; Hammer et al.; Woyach et al. Blood 124.24 (2014). In some embodiments, MOR-208 can be used to treat NHL (e.g., FL, MCL, DLBCL), CLL, small lymphocytic lymphoma, prolymphocytic leukemia, or B-cell Acute Lymphoblastic Leukemia (B-ALL).

In some embodiments, MOR-208 is administered intravenously, e.g., as an intravenous infusion. In some embodiments, MOR-208 is administered at a dose of about 0.3 to 12 mg/kg, e.g., about 0.3-0.5 mg/kg, 0.5-1 mg/kg, 1-2 mg/kg, 2-4 mg/kg, 3-6 mg/kg, 6-9 mg/kg, or 9-12 mg/kg.

In some embodiments, MOR-208 is administered at a dosing interval of at least 2 days, e.g., 2, 3, 4, 5, 6, 7, 14, 21, 28, 35 days, or more. For example, MOR-208 is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, MOR-208 is administered at a dose and dosing interval described herein for a period of time, e.g., at least 1 week, e.g., at least 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, MOR-208 is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspect, the anti-CD19 antibody or fragment or conjugate thereof comprises SAR3419. SAR3419 is an anti-CD19 antibody-drug conjugate (ADC) comprising an anti-CD19 humanized monoclonal antibody conjugated to a maytansine derivative via a cleavable linker. See, e.g., Younes et al. J. Clin. Oncol. 30.2 (2012): 2776-82; Hammer et al.; Clinical Trial Identifier No. NCT00549185; and Blanc et al. Clin Cancer Res. 2011; 17:6448-58. In some embodiments, SAR3419 can be used to treat NHL (diffuse large B-cell lymphoma (DLBCL) and follicular small cleaved cell lymphoma) or B-cell ALL.

In some embodiments, SAR3419 is administered intravenously, e.g., as an intravenous infusion. In some embodiments, SAR3419 is administered at a dose of about 10-270 mg/m$^2$, e.g., about 10-25 mg/m$^2$, 25-50 mg/m$^2$, 50-75 mg/m$^2$, 75-100 mg/m$^2$, 100-125 mg/m$^2$, 125-150 mg/m$^2$, 150-175 mg/m$^2$, 175-200 mg/m$^2$, 200-225 mg/m$^2$, 225-250 mg/m$^2$, or 250-270 mg/m$^2$.

In some embodiments, SAR3419 is administered at a dosing interval of at least 7 days, e.g., 7, 14, 21, 28, 35 days, or more. For example, SAR3419 is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, SAR3419 is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, SAR3419 is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspects, the anti-CD19 antibody comprises XmAb-5871. XmAb-5871 is an Fc-engineered, humanized anti-CD19 antibody. In some embodiments, XmAb-5871 can be used to treat autoimmune diseases, such as lupus. See, e.g., Hammer et al.

In some aspects, the anti-CD19 antibody comprises MDX-1342, which is a human Fc-engineered anti-CD19 antibody with enhanced ADCC. In some embodiments, MDX-1342 can be used to treat CLL and rheumatoid arthritis. See, e.g., Hammer et al.

In some aspects, the anti-CD19 antibody comprises AFM11. AFM11 is a bispecific antibody that targets CD19 and CD3. In some embodiments, AFM11 can be used to treat NHL (e.g., DLBCL), ALL, or CLL. See, e.g., Hammer et al.; and Clinical Trial Identifier No. NCT02106091. In some embodiments, AFM11 is administered as an intravenous infusion.

In some embodiments, an anti-CD19 antibody described herein is conjugated or otherwise bound to a therapeutic agent, e.g., a chemotherapeutic agent (e.g., a chemotherapeutic agent described herein), peptide vaccine (such as that described in Izumoto et al. 2008 J Neurosurg 108:963-971), immunosuppressive agent (e.g., an immunosuppressive agent described herein), or immunoablative agent (e.g., an immunoablative agent described herein), e.g., cyclosporin, azathioprine, methotrexate, mycophenolate, FK506, CAMPATH, anti-CD3 antibody, cytoxin, fludarabine, rapamycin, mycophenolic acid, steroid, FR901228, or cytokine.

In some embodiments, a CD19 inhibitor includes an anti-CD19 CAR-expressing cell, e.g., CART, e.g., a cell expressing an anti-CD19 CAR construct. In an embodiment, the anti-CD19 CAR construct comprises a murine scFv sequence. For example, the anti-CD19 CAR construct comprising a murine scFv sequence is the CAR19 construct provided in PCT publication WO2012/079000; a CAR19 construct provided in U.S. Pat. No. 7,446,190; a CAR19 construct provided in WO2014/031687; or a CAR19 construct provided in GenBank Accession No. HM852952 and provided herein as SEQ ID NO: 223. In one embodiment, the anti-CD19 binding domain is a scFv described in WO2012/079000. In one embodiment, the anti-CD19 binding domain is a scFv described in U.S. Pat. No. 7,446,190. In one embodiment, the anti-CD19 binding domain is a scFv described in WO2014/031687. In one embodiment, the anti-CD19 binding domain is a scFv described in GenBank Accession No. HM852952, or a sequence at least 95%, e.g., 95-99%, identical thereto. In an embodiment, the anti-CD19 binding domain is part of a CAR construct provided in PCT publication WO2012/079000. In an embodiment, the anti-CD19 binding domain is part of a CAR construct provided in U.S. Pat. No. 7,446,190. In an embodiment, the anti-CD19 binding domain is part of a CAR construct provided in WO2014/031687. In an embodiment, the anti-CD19 binding domain is part of a CAR construct provided in GenBank Accession No. HM852952. In some cases, the anti-CD19 antigen binding domain of the CAR is a scFv antibody fragment that is humanized compared to the murine sequence of the scFv from which it is derived. For example, the anti-CD19 antigen binding domain of the CAR is a humanized scFv antibody fragment, e.g., as described in PCT publication WO2014/153270, incorporated herein by reference. In an embodiment, the anti-CD19 binding domain comprises at least one (e.g., 2, 3, 4, 5, or 6) sequence from Table 11.

For example, an anti-CD19 CAR-expressing cell, e.g., CART, is a generated by engineering a CD19-CAR (that comprises a CD19 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CAR-expressing cell, comprising a mixture of cells expressing CD20 CARs and CD19 CARs. For example, in one embodiment, the population of CAR-expressing cell can include a first cell expressing a CD20 CAR and a second cell expressing a CD19 CAR.

CD123 Inhibitors

CD123 is also called the alpha-chain of the interleukin-3 receptor (IL-3RA). The IL-3 receptor (IL-3R) is a heterodimer composed of alpha and beta chains. IL-3R is a membrane receptor. The IL-3Rα chain is a glycoprotein of 360 amino acid residues.ABnormalities of CD123 are frequently observed in some leukemic disorders. CD123 is overexpressed in multiple hematologic malignancies, e.g., acute myeloid and B-lymphoid leukemias, blastic plasmocytoid dendritic neoplasms (BPDCN) and hairy cell leukemia.

Provided herein are CD123 inhibitors and combination therapies. CD123 inhibitors include but are not limited to small molecules, recombinant proteins, anti-CD123 CAR-expressing cells, e.g. CARTs, and anti-CD123 antibodies (e.g., an anti-CD123 mono- or bispecific antibody) and fragments thereof. In some embodiments, anti-CD123 inhibitors can be used to treat a B-cell malignancy described herein. In an embodiment, the CD123 inhibitor is administered in combination with a CD20 inhibitor, e.g., a CD20 CAR-expressing cell, e.g., a CAR-expressing cell described herein, e.g., a cell expressing a CAR comprising an antibody binding domain that is murine, human, or humanized.

In one embodiment, the CD123 inhibitor is a recombinant protein, e.g., comprising the natural ligand (or a fragment) of the CD123 receptor. For example, the recombinant protein is SL-401 (also called DT388IL3; University of Texas Southwestern Medical Center), which is a fusion protein comprising human IL-3 fused to a truncated diphtheria toxin. See, e.g., Testa et al. Biomark Res. 2014; 2: 4; and Clinical Trial Identifier No. NCT00397579.

In another embodiment, the CD123 inhibitor is an anti-CD123 antibody or fragment thereof. In one embodiment, the anti-CD123 antibody or fragment thereof comprises a monoclonal antibody, e.g., a monospecific or bispecific antibody or fragment thereof. For example, the anti-CD123 antibody or fragment thereof comprises CSL360 (CSL Limited). CSL360 is a recombinant chimeric monoclonal antibody that binds to CD123. In some embodiments, CSL360 is administered intravenously, e.g., by intravenous infusion. For example, CSL360 is administered at a dose of 0.1-10 mg/kg, e.g., 0.1-0.5 mg/kg, 0.5-1 mg/kg, 1-5 mg/kg, or 5-10 mg/kg. See, e.g., Clinical Trial Identifier No. NCT01632852; and Testa et al.

In another embodiment, the CD123 antibody or fragment thereof comprises CSL362 (CSL Limited). CSL362 is a humanized monoclonal antibody that targets the CD123 and is optimized for enhanced activation of antibody dependent cell-mediated cytotoxicity (ADCC). In some embodiments, CSL362 is administered intravenously, e.g., by intravenous infusion. In some examples, CSL362 is administered at a dose of 0.1-12 mg/kg, e.g., 0.1-0.2 mg/kg, 0.2-0.5 mg/kg, 0.5-1 mg/kg, 1-6 mg/kg, or 6-12 mg/kg. See, e.g., Clinical Trial Identifier No. NCT01632852.

In one embodiment, the CD123 antibody or fragment thereof comprises a bispecific antibody, e.g., MGD006 (MacroGenics). MGD006 is a bispecific antibody that targets CD123 and CD3. See, e.g., Clinical Trial Identifier No. NCT02152956.

In some embodiments, the CD123 inhibitor is conjugated or otherwise bound to a therapeutic agent.

In some embodiments, a CD123 inhibitor includes an anti-CD123 CAR-expressing cell, e.g., CART, e.g., a cell expressing an anti-CD123 CAR construct or encoded by a CD123 binding CAR comprising a scFv, CDRs, or VH and VL chains. For example, an anti-CD123 CAR-expressing cell, e.g., CART is a generated by engineering a CD123-CAR (that comprises a CD123 binding domain) into a cell (e.g., a T cell or NK cell), e.g., for administration in combination with a CAR-expressing cell described herein. In an embodiment, the anti-CD123 CAR construct comprises a scFv sequence, e.g., a scFv sequence provided in US 2014/0322212 A1, incorporated herein by reference. In one embodiment, the anti-CD123 binding domain is a scFv described in US 2014/0322212 A1. In an embodiment, the anti-CD123 binding domain is part of a CAR construct provided in US 2014/0322212 A1. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD20 CARs and CD123 CARs. For example, in one embodiment, the population of CAR-expressing cells can include a first cell expressing a CD20 CAR and a second cell expressing a CD123 CAR.

CD10 Inhibitors

Cluster of differentiation 10 (CD10) is also called Neprilysin, membrane metallo-endopeptidase (MME), neutral endopeptidase (NEP), and common acute lymphoblastic leukemia antigen (CALLA). CD10 is an enzyme encoded by the membrane metallo-endopeptidase (MME) gene. CD10 is expressed on leukemic cells of pre-B phenotype and is a common acute lymphocytic leukemia antigen.

Also provided herein are CD10 inhibitors and combination therapies. CD10 inhibitors include but are not limited to small molecules, recombinant proteins, anti-CD10 CAR-expressing cells, e.g. CARTs, and anti-CD10 antibodies (e.g., an anti-CD10 mono- or bispecific antibody) and fragments thereof. In some embodiments, anti-CD10 inhibitors can be used to treat a B-cell malignancy described herein. In an embodiment, the CD10 inhibitor is administered in combination with a CD20 inhibitor, e.g., a CD20 CAR-expressing cell, e.g., a CAR-expressing cell described herein, e.g., a cell expressing a CAR comprising an antibody binding domain that is murine, human, or humanized.

In an embodiment, the CD10 inhibitor comprises a small molecule, such as sacubitril (Novartis), valsartan/sacubritril (Novartis), omapatrilat (Bristol-Myers Squibb), RB-101, UK-414,495 (Pfizer), or a pharmaceutically acceptable salt or a derivative thereof.

In an embodiment, the CD10 inhibitor comprises sacubitril (AHU-377; Novartis) (4-{[(2S,4R)-1-(4-Biphenylyl)-5-ethoxy-4-methyl-5-oxo-2-pentanyl]amino}-4-oxobutanoic acid), or a pharmaceutically acceptable salt or a derivative thereof. The structure of sacubitril is shown below.

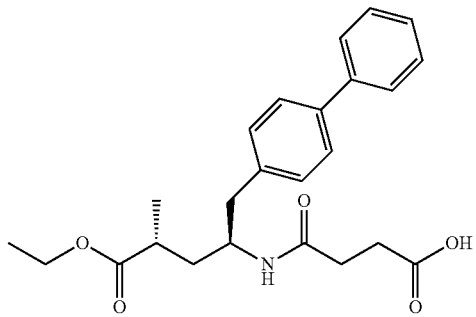 [SMILES: CCOC(=O)[C@H](C)C[C@@H](Cc1ccc(-c2ccccc2)cc1)NC(=O)CCC(=O)O]

In another embodiment, the CD10 inhibitor comprises valsartan/sacubritril (LCZ696; Novartis) or a pharmaceutically acceptable salt or a derivative thereof. Valsartan/sacubritril is a combination drug comprising a 1:1 mixture of valsartan and sacubitril. The structure of valsartan ((S)-3-methyl-2-(N-{[2'-(2H-1,2,3,4-tetrazol-5-yl)biphenyl-4-yl]methyl}pentanamido)butanoic acid) is shown below.

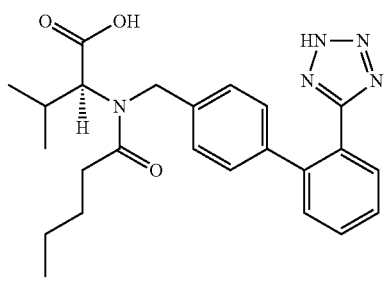 [SMILES: CCCCC(=O)N(Cc1ccc(-c2ccccc2-c2nn[nH]n2)cc1)[C@H](C(=O)O)C(C)C]

In an embodiment, the CD10 inhibitor comprises omapatrilat (Bristol-Myers Squibb) ((4S,7S,10aS)-5-oxo-4-{[(2S)-3-phenyl-2-sulfanylpropanoyl]amino}-2,3,4,7,8,9,10,10a-octahydropyrido[6,1-b][1,3]thiazepine-7-carboxylic acid), or a pharmaceutically acceptable salt or a derivative thereof. The structure of omapatrilat is shown below.

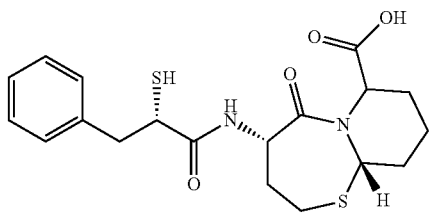 [SMILES: O=C(O)C1CCC[C@@H]2SCC[C@H](NC(=O)[C@@H](S)Cc3ccccc3)C(=O)N12]

In an embodiment, the CD10 inhibitor comprises RB-101 (benzyl N-(3-{[(2S)-2-amino-4-(methylthio)butyl]dithio}-2-benzylpropanoyl)-L-phenylalaninate), or a pharmaceutically acceptable salt or a derivative thereof. The structure of RB-101 is shown below.

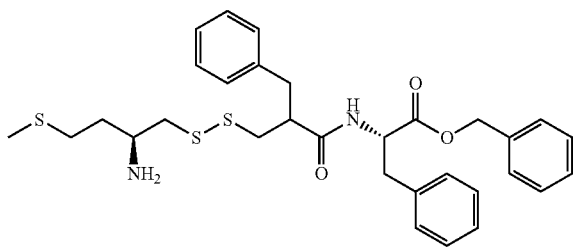 [SMILES: CSCC[C@H](N)CSSCC(Cc1ccccc1)C(=O)N[C@@H](Cc1ccccc1)C(=O)OCc1ccccc1]

In an embodiment, the CD10 inhibitor comprises UK-414,495 (Pfizer) ((R)-2-({1-[(5-ethyl-1,3,4-thiadiazol-2-yl)carbamoyl]cyclopentyl}methyl)valeric acid), or a pharmaceutically acceptable salt or a derivative thereof. The structure of UK-414,495 is shown below.

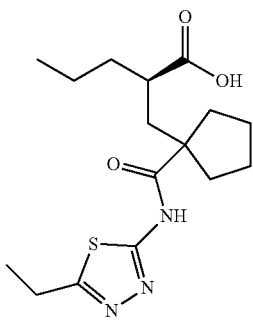 [SMILES: CCC[C@H](CC1(C(=O)Nc2nnc(CC)s2)CCCC1)C(=O)O]

In some embodiments, the CD10 inhibitor is conjugated or otherwise bound to a therapeutic agent.

In some embodiments, a CD10 inhibitor includes an anti-CD10 CAR-expressing cell, e.g., CART, e.g., a cell expressing an anti-CD10 CAR construct or encoded by a CD10 binding CAR comprising a scFv, CDRs, or VH and VL chains. For example, an anti-CD10 CAR-expressing cell, e.g., CART is a generated by engineering a CD10-CAR (that comprises a CD10 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD20 CARs and CD10 CARs. For example, in one embodiment, the population of CAR-expressing cells can include a first cell expressing a CD20 CAR and a second cell expressing a CD10 CAR.

CD34 Inhibitors

Cluster of differentiation 34 (CD34) is also called hematopoietic progenitor cell antigen CD34 and is a cell surface glycoprotein that functions as a cell-cell adhesion factor. CD34 is sometimes expressed on some cancers/tumors, e.g., alveolar soft part sarcoma, preB-ALL, AML, AML-M7, dermatofibrosarcoma protuberans, gastrointestinal stromal tumors, giant cell fibroblastoma, granulocytic sarcoma, Kaposi's sarcoma, liposarcoma, malignant fibrous histiocytoma, malignant peripheral nerve sheath tumors, mengingeal hemangiopericytomas, meningiomas, neurofibromas, schwannomas, and papillary thyroid carcinoma.

Also provided herein are CD34 inhibitors and combination therapies. CD34 inhibitors include but are not limited to small molecules, recombinant proteins, anti-CD34 CAR-expressing cells, e.g. CARTs, and anti-CD34 antibodies (e.g., an anti-CD34 mono- or bispecific antibody) and fragments thereof. In some embodiments, anti-CD34 inhibitors can be used to treat a B-cell malignancy described herein. In an embodiment, the CD34 inhibitor is administered in combination with a CD20 inhibitor, e.g., a CD20 CAR-expressing cell, e.g., a CAR-expressing cell described herein, e.g., a cell expressing a CAR comprising an antibody binding domain that is murine, human, or humanized.

In an embodiment, the CD34 inhibitor comprises a monoclonal antibody or fragment thereof that targets CD34 or an immunoliposome comprising an anti-CD34 monoclonal antibody or fragment thereof.

In an embodiment, the CD34 inhibitor comprises an antibody or fragment thereof, e.g., the My-10 monoclonal antibody or an immunoliposome comprising the My-10 monoclonal antibody, as described in Mercadal et al. Biochim. Biophys. Acta. 1371.1 (1998):17-23. In some embodiments, the CD34 inhibitor comprises an immunoliposome containing a cancer drug, e.g., doxorubicin, that is targeted to CD34-expressing cells, as described in Carrion et al. Life Sci. 75.3 (2004):313-28. In an embodiment, the CD34 inhibitor comprises a monoclonal antibody against CD34 as described in Maleki et al. Hum. Antibodies. 22(2013):1-8. In another embodiment, the CD34 inhibitor comprises a monoclonal antibody that targets CD34, as described in Maleki et al. Cell J. 16.3 (2014):361-66.

In some embodiments, the CD34 inhibitor is conjugated or otherwise bound to a therapeutic agent.

In some embodiments, a CD34 inhibitor includes an anti-CD34 CAR-expressing cell, e.g., CART, e.g., a cell expressing an anti-CD34 CAR construct or encoded by a CD34 binding CAR comprising a scFv, CDRs, or VH and VL chains. For example, an anti-CD34 CAR-expressing cell, e.g., CART is a generated by engineering a CD34-CAR (that comprises a CD34 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD20 CARs and CD34 CARs. For example, in one embodiment, the population of CAR-expressing cells can include a first cell expressing a CD20 CAR and a second cell expressing a CD34 CAR.

FLT-3 Inhibitors

Fms-like tyrosine kinase 3 (FLT-3), also called Cluster of differentiation antigen 135 (CD135), receptor-type tyrosine-protein kinase FLT3, or fetal liver kinase-2 (Flk2), is a receptor tyrosine kinase. FLT-3 is a cytokine receptor for the ligand, cytokine Flt3 ligand (FLT3L). FLT-3 is expressed on the surface of many hematopoietic progenitor cells and is important for lymphocyte development. The FLT3 gene is commonly mutated in leukemia, e.g., acute myeloid leukemia (AML).

Also provided herein are FLT-3 inhibitors and combination therapies. FLT-3 inhibitors include but are not limited to small molecules, recombinant proteins, anti-FLT-3 CAR-expressing cells, e.g. CARTs, and anti-FLT-3 antibodies (e.g., an anti-FLT-3 mono- or bispecific antibody) and fragments thereof. In some embodiments, anti-FLT-3 inhibitors can be used to treat a B-cell malignancy described herein. In an embodiment, the FLT-3 inhibitor is administered in combination with a CD20 inhibitor, e.g., a CD20 CAR-expressing cell, e.g., a CAR-expressing cell described herein, e.g., a cell expressing a CAR comprising an antibody binding domain that is murine, human, or humanized.

In some embodiments, the FLT-3 inhibitor comprises a small molecule, such as quizartinib (Ambit Biosciences), midostaurin (Technische Universitat Dresden), sorafenib (Bayer and Onyx Pharmaceuticals), sunitinib (Pfizer), lestaurtinib (Cephalon), or a pharmaceutically acceptable salt or derivative thereof.

In some embodiments, the FLT-3 inhibitor comprises quizartinib (AC220; Ambit Biosciences) or a pharmaceutically acceptable salt or a derivative thereof. Quizartinib is a small molecule receptor tyrosine kinase inhibitor. The structure of quizartinib (1-(5-(tert-Butyl)isoxazol-3-yl)-3-(4-(7-(2-morpholinoethoxy)benzo[d]imidazo[2,1-b]thiazol-2-yl)phenyl)urea) is shown below.

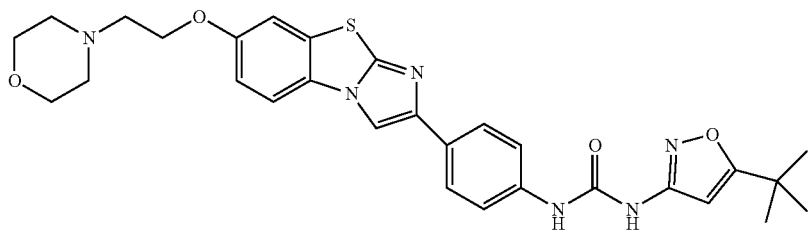 [SMILES: CC(C)(C)c1cc(NC(=O)Nc2ccc(-c3cn4c(n3)sc3cc(OCCN5CCOCC5)ccc34)cc2)no1]

In some embodiments, the FLT-3 inhibitor comprises midostaurin is (PKC412; Technische Universitat Dresden) or a pharmaceutically acceptable salt or a derivative thereof. Midostaurin is a protein kinase inhibitor that is a semi-synthetic derivative of staurosporine, an alkaloid from the bacterium *Streptomyces staurosporeus*.

The structure of midostaurin ((9S,10R,11R,13R)-2,3,10,11,12,13-Hexahydro-10-methoxy-9-methyl-11-(methylamino)-9,13-epoxy-1H,9H-diindolo[1,2,3-gh:3',2',1'-lm]pyrrolo[3,4-j][1,7]benzodiazonine-1-one) is shown below.

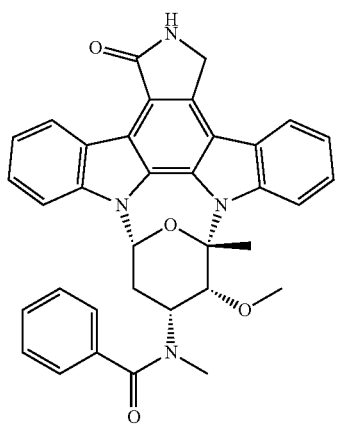 [SMILES: CO[C@@H]1[C@H](N(C)C(=O)c2ccccc2)C[C@H]2O[C@]1(C)n1c3ccccc3c3c4c(c5c6ccccc6n2c5c31)C(=O)NC4]

In some embodiments, midostaurin is administered orally, e.g., at a dose of about 25-200 mg, e.g., about 25-50 mg, 50-100 mg, 100-150 mg, or 150-200 mg. For example, midostaurin is administered, e.g., orally, at a dose of about 25-200 mg twice daily, e.g., about 25-50 mg, 50-100 mg, 100-150 mg, or 150-200 mg twice daily. See, e.g., Clinical Trial Identifier No. NCT01830361.

In an embodiment, the FLT-3 inhibitor comprises sorafenib (Bayer and Onyx Pharmaceuticals) or a pharmaceutically acceptable salt or a derivative thereof. Sorafenib is a small molecular inhibitor of multiple tyrosine protein kinases (e.g., VEGFR and PDGFR), Raf kinases (e.g., C-Raf and B-Raf), and some intracellular serine/threonine kinases (e.g. C-Raf, wild-type B-Raf, and mutant B-Raf). See, e.g., labeling.bayerhealthcare.com/html/products/pi/Nexavar_PI.pdf. The structure of sorafenib (4-[4-[[4-chloro-3-(trifluoromethyl)phenyl]carbamoylamino]phenoxy]-N-methyl-pyridine-2-carboxamide) is shown below.

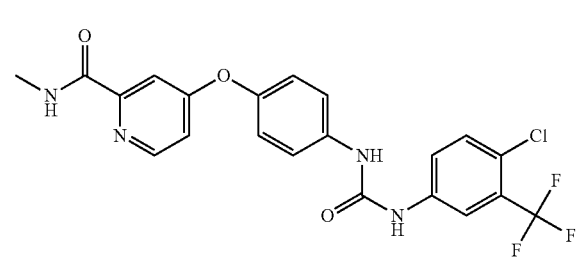 [SMILES: CNC(=O)c1cc(Oc2ccc(NC(=O)Nc3ccc(Cl)c(C(F)(F)F)c3)cc2)ccn1]

In some embodiments, the FLT-3 inhibitor comprises sunitinib (previously known as SU11248; Pfizer) or a pharmaceutically acceptable salt or derivative thereof. Sunitinib is a small molecule oral drug that inhibits multiple receptor tyrosine kinases, including FLT3. Sunitinib has been approved by the Food and Drug Administration (FDA) for the treatment of renal cell carcinoma (RCC) and imatinib-resistant gastrointestinal stromal tumor (GIST). The structure of sunitinib (N-(2-diethylaminoethyl)-5-[(Z)-(5-fluoro-2-oxo-1H-indol-3-ylidene)methyl]-2,4-dimethyl-1H-pyrrole-3-carboxamide) is shown below.

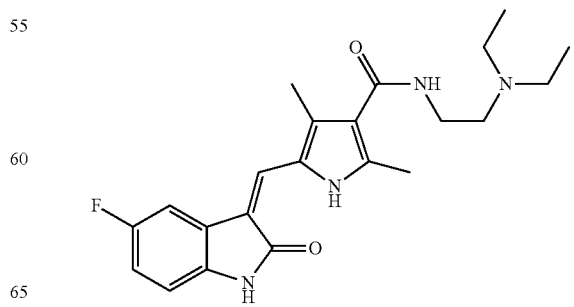

In some embodiments, the FLT-3 inhibitor comprises lestaurtinib (CEP-701; Cephalon) or a pharmaceutically acceptable salt or derivative thereof. Lestaurtinib is a tyrosine kinase inhibitor that is structurally related to staurosporine. The structure of lestaurtinib ((9S,10S,12R)-2,3,9,10,11,12-Hexahydro-10-hydroxy-10-(hydroxymethyl)-9-methyl-9,12-epoxy-1H-diindolo[1,2,3-fg:3',2',1'-kl]pyrrolo[3,4-i][1,6]benzodiazocin-1-one) is shown below.

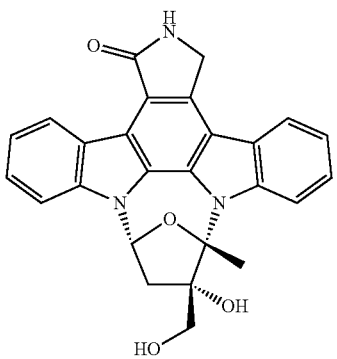 [SMILES: C[C@]12O[C@H](C[C@]1(O)CO)n1c3ccccc3c3c4c(c5c6ccccc6n2c5c31)CNC4=O]

In some embodiments, lestaurtinib is administered orally, e.g., at a dose of about 40-100 mg twice a day, e.g., about 40-60 mg, 50-70 mg, 60-80 mg, 70-90 mg, or 80-100 mg twice a day. See, e.g., Clinical Trial Identifier No. NCT00079482; or NCT00030186.

In some embodiments, the FLT-3 inhibitor is conjugated or otherwise bound to a therapeutic agent.

In some embodiments, a FLT-3 inhibitor includes an anti-FLT-3 CAR-expressing cell, e.g., CART, e.g., a cell expressing an anti-FLT-3 CAR construct or encoded by a FLT-3 binding CAR comprising a scFv, CDRs, or VH and VL chains. For example, an anti-FLT-3 CAR-expressing cell, e.g., CART is a generated by engineering a FLT-3-CAR (that comprises a FLT-3 binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD20 CARs and FLT-3 CARs. For example, in one embodiment, the population of CAR-expressing cells can include a first cell expressing a CD20 CAR and a second cell expressing a FLT-3 CAR.

CD79b Inhibitors

CD79b is also called immunoglobulin-associated beta, which is a component of the B lymphocyte antigen receptor multimeric complex. CD79b forms a heterodimer with another accessory protein called CD79a (immunoglobulin-associated alpha), and the heterodimer complexes with surface immunoglobulins on B cells. CD79b is important for the assembly of and surface expression of the B lymphocyte antigen receptor. CD79b and CD79a are important for pre-B-cell and B-cell development. Mutations and aberrant CD79b expression occurs in many B-CLL cells and may be correlated with the loss of surface expression and/or defective signaling of B lymphocyte antigen receptor in B-CLL. See, e.g., Thompson et al. Blood 90.4 (1997):1387-94. In some cases, overexpression of a mutant form or splice variant of CD79b has been correlated with diminished B lymphocyte antigen receptor in B-CLL and other lymphoid malignancies. See, e.g., Cragg et al. Blood 100.9 (2002): 3068-76.

Provided herein are CD79b inhibitors and combination therapies. CD79b inhibitors include but are not limited to small molecules, recombinant proteins, anti-CD79b CAR-expressing cells, e.g. CARTs, and anti-CD79b antibodies (e.g., an anti-CD79b mono- or bispecific antibody) and fragments thereof. In some embodiments, anti-CD79b inhibitors can be used to treat a B-cell malignancy described herein. In an embodiment, the CD79b inhibitor is administered in combination with a CD20 inhibitor, e.g., a CD20 CAR-expressing cell, e.g., a CAR-expressing cell described herein, e.g., a cell expressing a CAR comprising an antibody binding domain that is murine, human, or humanized.

In an embodiment, the CD79b inhibitor is an anti-CD79b antibody or fragment thereof. In one embodiment, the anti-79b antibody or fragment thereof comprises a monoclonal antibody, e.g., a monospecific or bispecific antibody or fragment thereof. For example, the anti-CD79b antibody or fragment thereof comprises polatuzumab vedotin (Roche), an anti-CD79b antibody drug conjugate. In embodiments, polatuzumab vedotin is used to treat a cancer, e.g., NHL, e.g., follicular lymphoma or DLBCL, e.g., relapsed or refractory follicular lymphoma or DLBCL. See, e.g., NCT02257567. In embodiments, the anti-CD79b antibody or fragment thereof comprises MGD010 (MacroGenics), which is a bispecific antibody comprising components that bind to CD32B and D79B. See, e.g., NCT02376036.

In some embodiments, the CD79b inhibitor is conjugated or otherwise bound to a therapeutic agent.

In some embodiments, a CD79b inhibitor includes an anti-CD79b CAR-expressing cell, e.g., CART, e.g., a cell expressing an anti-CD79b CAR construct or encoded by a CD79b binding CAR comprising a scFv, CDRs, or VH and VL chains. For example, an anti-CD79b CAR-expressing cell, e.g., CART is a generated by engineering a CD79b-CAR (that comprises a CD79b binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD20 CARs and CD79b CARs. For example, in one embodiment, the population of CAR-expressing cells can include a first cell expressing a CD20 CAR and a second cell expressing a CD79b CAR.

CD79a Inhibitors

CD79a is also called immunoglobulin-associated alpha. CD79a heterodimerizes with CD79b to form a component of the B lymphocyte antigen receptor multimeric complex. CD79a is expressed in many hematological cancers, e.g., acute leukemias (e.g., AML), B-cell Lymphomas, and Myelomas.

Provided herein are CD79a inhibitors and combination therapies. CD79a inhibitors include but are not limited to small molecules, recombinant proteins, anti-CD79a CAR-expressing cells, e.g. CARTs, and anti-CD79a antibodies (e.g., an anti-CD79a mono- or bispecific antibody) and fragments thereof. In some embodiments, anti-CD79a inhibitors can be used to treat a B-cell malignancy described herein. In an embodiment, the CD79a inhibitor is administered in combination with a CD20 inhibitor, e.g., a CD20 CAR-expressing cell, e.g., a CAR-expressing cell described herein, e.g., a cell expressing a CAR comprising an antibody binding domain that is murine, human, or humanized.

In an embodiment, the CD79a inhibitor is an anti-CD79a antibody or fragment thereof. In one embodiment, the anti- CD79a antibody or fragment thereof comprises a monoclonal antibody, e.g., a monospecific or bispecific antibody or fragment thereof. For example, the anti-CD79a antibody or fragment thereof comprises an anti-CD79a antibody or fragment thereof described in Polson et al. Blood 110.2 (2007):616-23, incorporated herein by reference. For example, the anti-CD79a antibody or fragment thereof comprises the 7H7, 15E4, or 16C11 antibody or fragment thereof described in Polson et al. See Id.

In some embodiments, the CD79a inhibitor is conjugated or otherwise bound to a therapeutic agent.

In some embodiments, a CD79a inhibitor includes an anti-CD79a CAR-expressing cell, e.g., CART, e.g., a cell expressing an anti-CD79a CAR construct or encoded by a CD79a binding CAR comprising a scFv, CDRs, or VH and VL chains. For example, an anti-CD79a CAR-expressing cell, e.g., CART is a generated by engineering a CD79a-CAR (that comprises a CD79a binding domain) into a cell (e.g., a T cell or NK cell), e.g., for administration in combination with a CAR-expressing cell described herein. Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD20 CARs and CD79a CARs. For example, in one embodiment, the population of CAR-expressing cells can include a first cell expressing a CD20 CAR and a second cell expressing a CD79a CAR.

CD179b Inhibitors

CD179b is also called immunoglobulin lambda-like polypeptide 1 (IGLL1). CD179b is a subunit of a heterodimeric light chain that complexes with a membrane-bound Ig mu heavy chain. Together, the light chain and heavy chain form the preB cell receptor. Mutations in CD179b have been correlated with B cell deficiency and agammaglobulinemia. CD179b is expressed in some cancer cells, e.g., precursor B-cell lymphoblastic lymphoma cells.

Provided herein are CD179b inhibitors and combination therapies. CD179b inhibitors include but are not limited to small molecules, recombinant proteins, anti-CD179b CAR-expressing cells, e.g. CARTs, and anti-CD179b antibodies (e.g., an anti-CD179b mono- or bispecific antibody) and fragments thereof. In some embodiments, anti-CD179b inhibitors can be used to treat a B-cell malignancy described herein. In an embodiment, the CD179b inhibitor is administered in combination with a CD20 inhibitor, e.g., a CD20 CAR-expressing cell, e.g., a CAR-expressing cell described herein, e.g., a cell expressing a CAR comprising an antibody binding domain that is murine, human, or humanized.

In an embodiment, the CD179b inhibitor is an anti-CD179b antibody or fragment thereof. In one embodiment, the anti-179b antibody or fragment thereof comprises a monoclonal antibody, e.g., a monospecific or bispecific antibody or fragment thereof.

In some embodiments, the CD179b inhibitor is conjugated or otherwise bound to a therapeutic agent.

In some embodiments, a CD179b inhibitor includes an anti-CD179b CAR-expressing cell, e.g., CART, e.g., a cell expressing an anti-CD179b CAR construct or encoded by a CD179b binding CAR comprising a scFv, CDRs, or VH and VL chains. For example, an anti-CD179b CAR-expressing cell, e.g., CART is a generated by engineering a CD179b-CAR (that comprises a CD179b binding domain) into a cell (e.g., a T cell or NK cell), e.g., for administration in combination with a CAR-expressing cell described herein.

Also provided herein are methods of use of the CAR-expressing cells described herein for adoptive therapy.

In another aspect, provided herein is a population of CAR-expressing cells, e.g., CART cells or CAR-expressing NK cells, comprising a mixture of cells expressing CD20 CARs and CD179b CARs. For example, in one embodiment, the population of CAR-expressing cells can include a first cell expressing a CD20 CAR and a second cell expressing a CD179b CAR.

CD20 Inhibitors

Provided herein are CD20 inhibitors and combination therapies, e.g., one or more CD20 inhibitors. In some embodiments, the methods and compositions (e.g., CD20 CAR-expressing cells) described herein further include a second CD20 inhibitor. For example, a CD20 CAR-expressing cell described herein is administered in combination with a second CD20 inhibitor. A CD20 inhibitor includes but is not limited to a CD20 CAR-expressing cell, e.g., a CD20 CART cell, a CD20 CAR-expressing NK cell, or an anti-CD20 antibody (e.g., an anti-CD20 mono- or bispecific antibody) or a fragment thereof.

In one embodiment, the second CD20 inhibitor is an anti-CD20 antibody or fragment thereof. In an embodiment, the antibody is a monospecific antibody, and in another embodiment, the antibody is a bispecific antibody. In an embodiment, the CD20 inhibitor is a chimeric mouse/human monoclonal antibody, e.g., rituximab. In an embodiment, the CD20 inhibitor is a human monoclonal antibody such as ofatumumab. In an embodiment, the CD20 inhibitor is a humanized antibody such as ocrelizumab, veltuzumab, obinutuzumab, ocaratuzumab, or PRO131921 (Genentech). In an embodiment, the CD20 inhibitor is a fusion protein comprising a portion of an anti-CD20 antibody, such as TRU-015 (Trubion Pharmaceuticals).

For example, the anti-CD20 antibody is chosen from rituximab, ofatumumab, ocrelizumab, veltuzumab, obinutuzumab, TRU-015 (Trubion Pharmaceuticals), ocaratuzumab, or Pro131921 (Genentech). See, e.g., Lim et al. Haematologica. 95.1 (2010):135-43.

In some embodiments, the anti-CD20 antibody comprises rituximab. Rituximab is a chimeric mouse/human monoclonal antibody IgG1 kappa that binds to CD20 and causes cytolysis of a CD20 expressing cell, e.g., as described in www.accessdata.fda.gov/drugsatfda_docs/label/2010/103705s53111bl.pdf.

In some embodiments, rituximab is administered intravenously, e.g., as an intravenous infusion. For example, each infusion provides about 500-2000 mg (e.g., about 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of rituximab.

In some embodiments, rituximab is administered at a dose of 150 mg/m$^2$ to 750 mg/m$^2$, e.g., about 150-175 mg/m$^2$, 175-200 mg/m$^2$, 200-225 mg/m$^2$, 225-250 mg/m$^2$, 250-300 mg/m$^2$, 300-325 mg/m$^2$, 325-350 mg/m$^2$, 350-375 mg/m$^2$, 375-400 mg/m$^2$, 400-425 mg/m$^2$, 425-450 mg/m$^2$, 450-475 mg/m$^2$, 475-500 mg/m$^2$, 500-525 mg/m$^2$, 525-550 mg/m$^2$, 550-575 mg/m$^2$, 575-600 mg/m$^2$, 600-625 mg/m$^2$, 625-650 mg/m$^2$, 650-675 mg/m$^2$, or 675-700 mg/m$^2$, where m$^2$ indicates the body surface area of the subject.

In some embodiments, rituximab is administered at a dosing interval of at least 4 days, e.g., 4, 7, 14, 21, 28, 35 days, or more. For example, rituximab is administered at a dosing interval of at least 0.5 weeks, e.g., 0.5, 1, 2, 3, 4, 5, 6, 7, 8 weeks, or more.

In some embodiments, rituximab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20 weeks, or greater. For example, rituximab is administered at a dose and dosing interval described herein for a total of at least 4 doses per treatment cycle (e.g., at least 4, 5, 6, 7, 8, 9, 10, 11, 12, 13, 14, 15, 16, or more doses per treatment cycle).

In some aspects, the anti-CD20 antibody comprises ofatumumab. Ofatumumab is an anti-CD20 IgG1κ human monoclonal antibody with a molecular weight of approximately 149 kDa. For example, ofatumumab is generated using transgenic mouse and hybridoma technology and is expressed and purified from a recombinant murine cell line (NS0). See, e.g., www.accessdata.fda.gov/drugsatfda_docs/label/2009/125326lbl.pdf; and Clinical Trial Identifier number NCT01363128, NCT01515176, NCT01626352, and NCT01397591.

In some embodiments, ofatumumab is administered as an intravenous infusion. For example, each infusion provides about 150-3000 mg (e.g., about 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of ofatumumab.

In some embodiments, ofatumumab is administered at a dosing interval of at least 4 days, e.g., 4, 7, 14, 21, 28, 35 days, or more. For example, ofatumumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, ofatumumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ofatumumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some aspects, the anti-CD20 antibody comprises ocrelizumab. Ocrelizumab is a humanized anti-CD20 monoclonal antibody, e.g., as described in Clinical Trials Identifier Nos. NCT00077870, NCT01412333, NCT00779220, NCT00673920, NCT01194570, and Kappos et al. Lancet. 19.378 (2011):1779-87.

In some embodiments, ocrelizumab is administered as an intravenous infusion. For example, each infusion provides about 50-2000 mg (e.g., about 50-100, 100-150, 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of ocrelizumab.

In some embodiments, ocrelizumab is administered at a dosing interval of at least 7 days, e.g., 7, 14, 21, 28, 35 days, or more. For example, ocrelizumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, ocrelizumab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ocrelizumab is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspects, the anti-CD20 antibody comprises veltuzumab. Veltuzumab is a humanized monoclonal antibody against CD20. See, e.g., Clinical Trial Identifier No. NCT00547066, NCT00546793, NCT01101581, and Goldenberg et al. Leuk Lymphoma. 51(5)(2010):747-55.

In some embodiments, veltuzumab is administered subcutaneously or intravenously, e.g., as an intravenous infusion. In some embodiments, veltuzumab is administered at a dose of 50-800 mg/m², e.g., about 50-60, 60-70, 70-80, 80-90, 90-100, 100-110, 110-120, 120-130, 130-140, 140-150, 150-160, 160-170, 170-180, 180-190, 190-200, 200-225, 225-250, 250-275, 275-300, 300-325, 325-350, 350-375, 375-400, 400-425, 425-450, 450-475, 475-500, 500-525, 525-550, 550-575, 575-600, 600-625, 625-650, 650-675, 675-700, 700-725, 725-750, 750-775, or 775-800 mg/m². In some embodiments, a dose of 50-400 mg, e.g., 50, 75, 100, 125, 150, 175, 200, 225, 250, 275, 300, 325, 350, 375, or 400 mg of veltuzumab is administered.

In some embodiments, veltuzumab is administered at a dosing interval of at least 7 days, e.g., 7, 14, 21, 28, 35 days, or more. For example, veltuzumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more.

In some embodiments, veltuzumab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, veltuzumab is administered at a dose and dosing interval described herein for a total of at least 4 doses per treatment cycle (e.g., at least 4, 5, 6, 7, 8, 9, 10, 11, 12, 13, 14, 15, 16, 18, 20, or more doses per treatment cycle).

In some aspects, the anti-CD20 antibody comprises GA101. GA101 (also called obinutuzumab or RO5072759) is a humanized and glyco-engineered anti-CD20 monoclonal antibody. See, e.g., Robak. Curr. Opin. Investig. Drugs. 10.6 (2009):588-96; Clinical Trial Identifier Numbers: NCT01995669, NCT01889797, NCT02229422, and NCT01414205; and www.accessdata.fda.gov/drugsatfda_docs/label/2013/125486s0001bl.pdf.

In some embodiments, GA101 is administered intravenously, e.g., as an intravenous infusion. For example, each infusion provides about 100-3000 mg (e.g., about 100-150, 150-200, 200-250, 250-500, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of GA101.

In some embodiments, GA101 is administered at a dosing interval of at least 7 days, e.g., 7, 14, 21, 28, 35 days, or more. For example, GA101 is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more. For example, GA101 is administered at a dosing interval of at least 1 month, e.g., 1, 2, 3, 4, 5, 6, 7, 8, 9, 10, 11, 12, or more months. In some embodiments, GA101 is administered at a dosing interval of 1, 2, 3, 4, 5, 6, 7, 8, 9, 10, 11, 12, 13, or 14 days.

In some embodiments, GA101 is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, GA101 is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some aspects, the anti-CD20 antibody comprises AME-133v. AME-133v (also called LY2469298 or ocaratuzumab) is a humanized IgG1 monoclonal antibody against CD20 with increased affinity for the FcγRIIIa receptor and an enhanced antibody dependent cellular cytotoxicity (ADCC) activity compared with rituximab. See, e.g., Robak et al. BioDrugs 25.1 (2011):13-25; and Forero-Torres et al. Clin Cancer Res. 18.5 (2012):1395-403.

In some aspects, the anti-CD20 antibody comprises PRO131921. PRO131921 is a humanized anti-CD20 monoclonal antibody engineered to have better binding to FcγRIIIa and enhanced ADCC compared with rituximab. See, e.g., Robak et al. BioDrugs 25.1 (2011):13-25; and Casulo et al. Clin Immunol. 154.1 (2014):37-46; Clinical Trial Identifier No. NCT00452127. In some embodiments, PRO131921 is administered intravenously, e.g., as an intravenous infusion. In some embodiments, PRO131921 is administered at a dose of 15 mg/m$^2$ to 1000 mg/m$^2$, e.g., about 15-20, 20-25, 25-30, 30-35, 35-40, 40-45, 45-50, 50-55, 55-60, 60-65, 65-70, 70-75, 75-80, 80-85, 85-90, 90-95, 95-100, 100-125, 125-150, 150-175, 175-200, 200-226, 225-250, 250-300, 300-325, 325-350, 350-375, 375-400, 400-425, 425-450, 450-475, 475-500, 500-525, 525-550, 550-575, 575-600, 600-625, 625-650, 650-675, 675-700, 700-725, 725-750, 750-775, 775-800, 800-825, 825-850, 850-875, 875-900, 900-925, 925-950, 950-975, or 975-1000 mg/m$^2$, where m$^2$ indicates the body surface area of the subject.

In some aspects, the anti-CD20 antibody comprises TRU-015. TRU-015 is an anti-CD20 fusion protein derived from domains of an antibody against CD20. TRU-015 is smaller than monoclonal antibodies, but retains Fc-mediated effector functions. See, e.g., Robak et al. BioDrugs 25.1 (2011):13-25. TRU-015 contains an anti-CD20 single-chain variable fragment (scFv) linked to human IgG1 hinge, CH2, and CH3 domains but lacks CH1 and CL domains. In some cases, TRU-015 is administered intravenously, e.g., as an intravenous infusion. In some embodiments, TRU-015 is administered at a dose of 0.01-30 mg/kg, e.g., 0.01-0.015, 0.015-0.05, 0.05-0.15, 0.15-0.5, 0.5-1, 1-1.5, 1.5-2.5, 2.5-5, 5-10, 10-15, 15-20, 20-25, or 25-30 mg/kg body weight. In some embodiments, TRU-015 is administered at a dosing interval of at least 1 day, e.g., 1, 2, 3, 4, 5, 6, 7, 8, 9, 10, 11, 12, 13, or 14 days apart. See, e.g., Burge et al. Clin Ther. 30.10 (2008):1806-16.

In some embodiments, an anti-CD20 antibody described herein is conjugated or otherwise bound to a therapeutic agent, e.g., a chemotherapeutic agent (e.g., a chemotherapeutic agent described herein, e.g., cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent, CD20 antibody, or CD20 antibody drug conjugate described herein), anti-allergic agent, anti-nausea agent (or anti-emetic), pain reliever, or cytoprotective agent described herein.

In one embodiment, the antigen binding domain CAR (e.g., a CD19, ROR1, CD20, CD22, CD123, CD10, CD34, FLT-3, CD79b, CD179b, or CD79a antigen binding domain) comprises an scFv portion, e.g., a human, humanized, or murine scFv portion. The scFv may be preceded by an optional leader sequence such as provided in SEQ ID NO: 797, and followed by an optional hinge sequence such as provided in SEQ ID NO: 799 or SEQ ID NO: 814 or SEQ ID NO: 816, a transmembrane region such as provided in SEQ ID NO: 801, an intracellular signaling domain that includes SEQ ID NO: 803 and a CD3 zeta sequence that includes SEQ ID NO: 805 or SEQ ID NO: 807, e.g., wherein the domains are contiguous with and in the same reading frame to form a single fusion protein.

In some embodiments, the present disclosure encompasses a recombinant nucleic acid construct comprising a nucleic acid molecule encoding a CAR (e.g., a CD19 CAR, a ROR1 CAR, a CD20 CAR, a CD22 CAR, a CD123 CAR, a CD10 CAR, a CD34 CAR, a FLT-3 CAR, a CD79b CAR, a CD179b CAR, or a CD79a CAR), wherein the nucleic acid molecule comprises the nucleic acid sequence encoding an antigen binding domain, e.g., described herein, e.g., that is contiguous with and in the same reading frame as a nucleic acid sequence encoding an intracellular signaling domain. An exemplary intracellular signaling domain that can be used in the CAR includes, but is not limited to, one or more intracellular signaling domains of, e.g., CD3-zeta, CD28, 4-1BB, and the like. In some instances, the CAR can comprise any combination of CD3-zeta, CD28, 4-1BB, and the like.

In one embodiment, the antigen binding domain (e.g., a CD19, ROR1, CD20, CD22, CD123, CD10, CD34, FLT-3, CD79b, CD179b, or CD79a antigen binding domain) is characterized by particular functional features or properties of an antibody or antibody fragment. For example, in one embodiment, the portion of a CAR composition of the invention that comprises an antigen binding domain specifically binds a human B-cell antigen (e.g., CD19, ROR1, CD20, CD22, CD123, CD10, CD34, FLT-3, CD79b, CD179b, or CD79a) or a fragment thereof. In certain embodiments, the scFv is contiguous with and in the same reading frame as a leader sequence. In one aspect the leader sequence is the polypeptide sequence provided as SEQ ID NO: 797.

In one embodiment, the antigen binding domain is a fragment, e.g., a single chain variable fragment (scFv). In one embodiment, the antigen binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a B-cell protein or a fragment thereof with wild-type or enhanced affinity. In some instances, a human scFv can be derived from a display library.

In one embodiment, the antigen binding domain, e.g., scFv comprises at least one mutation such that the mutated scFv confers improved stability to the CAR construct. In another embodiment, the antigen binding domain, e.g., scFv comprises at least 1, 2, 3, 4, 5, 6, 7, 8, 9, 10 mutations arising from, e.g., the humanization process such that the mutated scFv confers improved stability to the CAR construct.

In one embodiment, the population of CAR-expressing cells includes, e.g., a first cell expressing a CAR (e.g., a CD19 CAR, a ROR1 CAR, a CD20 CAR, a CD22 CAR, a CD123 CAR, a CD10 CAR, a CD34 CAR, a FLT-3 CAR, a CD79b CAR, a CD179b CAR, or a CD79a CAR) that includes a primary intracellular signaling domain, and a second cell expressing a CAR (e.g., a CD19 CAR, a ROR1

CAR, a CD20 CAR, a CD22 CAR, a CD123 CAR, a CD10 CAR, a CD34 CAR, a FLT-3 CAR, a CD79b CAR, a CD179b CAR, or a CD79a CAR) that includes a secondary signaling domain.

In some embodiments, a first and second CAR molecules are expressed in different cells, e.g., a first and second cells.

In some embodiments, a first and second CAR molecules are expressed in the same cell, e.g., the same immune effector cell.

In one embodiment, the first CAR molecule is a CD19 CAR and the second CAR molecule is a CD22. In one embodiment, the first CAR molecule is a CD19 CAR and the second CAR molecule is a CD20. In one embodiment, the first CAR molecule is a CD20 CAR and the second CAR molecule is a CD22. In some embodiments, the same cell or a different cell expresses two CARs (e.g., a CD19 CAR and a CD20 CAR described herein; a CD19 CAR and a CD22 CAR described herein; a CD20 CAR described herein and a CD22 CAR described herein; or more than two CARs, e.g., a CD22 CAR described herein, a CD20 CAR described herein and a CD19 CAR described herein. In some embodiments, nucleic acid encoding the more than one CAR molecules can be introduced into the cell on a single vector, for example with a 2A or IRES site disposed between the nucleic acid encoding the first and second CAR molecules, or can be introduced via more than one vector, for example, a first vector comprising nucleic acid sequence encoding a first CAR and a second vector comprising nucleic acid sequence encoding a second CAR.

Pharmaceutical Compositions and Treatments

Pharmaceutical compositions of the present invention may comprise a CAR-expressing cell, e.g., a plurality of CAR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia,* and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). In some embodiments, a pharmaceutical composition comprising the cells, e.g., T cells or NK cells described herein may be administered at a dosage of $10^4$ to $10^9$ cells/kg body weight, in some instances $10^5$ to $10^6$ cells/kg body weight, including all integer values within those ranges. In some embodiments, the cells, e.g., T cells or NK cells described herein may be administered at $3 \times 10^4$, $1 \times 10^6$, $3 \times 10^6$, or $1 \times 10^7$ cells/kg body weight. The cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer activated cells, e.g., T cells or NK cells, to a subject and then subsequently redraw blood (or have an apheresis performed), activate the cells therefrom according to the present invention, and reinfuse the patient with these activated and expanded cells. This process can be carried out multiple times every few weeks. In certain aspects, cells, e.g., T cells or NK cells, can be activated from blood draws of from 10 cc to 400 cc. In certain aspects, cells, e.g., T cells or NK cells, are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the cell compositions, e.g., T cell or NK cell compositions, of the present invention are administered to a patient by intradermal or subcutaneous injection. In one aspect, the cell compositions, e.g., T cell or NK cell compositions, of the present invention are administered by i.v. injection. The compositions of cells, e.g., T cell or NK cell compositions, may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T or NK cells. These cell isolates, e.g., T cell or NK cell isolates, may be expanded by methods known in the art and treated such that one or more CAR constructs of the invention may be introduced, thereby creating a CAR-expressing cell, e.g., CAR T cell or CAR-expressing NK cell, of the invention. Subjects in need thereof may subsequently undergo standard treatment with high dose chemotherapy followed by peripheral blood stem cell transplantation. In certain aspects, following or concurrent with the transplant, subjects receive an infusion of the expanded CAR-expressing cells of the present invention. In an additional aspect, expanded cells are administered before or following surgery.

In embodiments, lymphodepletion is performed on a subject, e.g., prior to administering one or more cells that express a CAR described herein, e.g., a CD20-binding CAR described herein. In embodiments, the lymphodepletion comprises administering one or more of melphalan, cytoxan, cyclophosphamide, and fludarabine.

The dosage of the above treatments to be administered to a patient will vary with the precise nature of the condition being treated and the recipient of the treatment. The scaling of dosages for human administration can be performed according to art-accepted practices. The dose for a therapeutic, e.g., an antibody, e.g., CAMPATH, for example, may generally be, e.g., in the range 1 to about 100 mg for an adult patient, e.g., administered daily for a period between 1 and 30 days. A suitable daily dose is 1 to 10 mg per day although in some instances larger doses of up to 40 mg per day may be used (described in U.S. Pat. No. 6,120,766).

In one embodiment, the CAR is introduced into cells, e.g., T cells or NK cells, e.g., using in vitro transcription, and the subject (e.g., human) receives an initial administration of CAR-expressing cells, e.g., CAR T cells or CAR-expressing NK cells of the invention, and one or more subsequent administrations of the CAR-expressing cells, e.g., CAR T cells or CAR-expressing NK cells of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR-expressing cells, e.g., CAR T cells or CAR-expressing NK cells of the invention are administered to the subject (e.g., human) per week, e.g., 2, 3, or 4 administrations of the CAR-expressing cells, e.g., CAR T cells or CAR-expressing NK cells of the invention are administered per week. In one embodiment, the subject (e.g., human subject) receives more than one administration of the CAR-expressing cells, e.g., CAR T cells per week or CAR-expressing NK cells (e.g., 2, 3 or 4 administrations per week) (also referred to herein as a cycle), followed by a week of no CAR-expressing cells, e.g., CAR T cell administrations or CAR-expressing NK cell administrations, and then one or more additional administration of the CAR-expressing cells, e.g., CAR T cells or CAR-expressing NK cells (e.g., more than one administration of the CAR-expressing cells, e.g., CAR T cells or CAR-expressing NK cells, per week) is administered to the subject. In another embodiment, the subject (e.g., human subject) receives more than one cycle of CAR-expressing cells, e.g., CAR T cells or CAR-expressing NK cells, and the time between each cycle is less than 10, 9, 8, 7, 6, 5, 4, or 3 days. In one embodiment, the CAR-expressing cells, e.g., CAR T cells or CAR-expressing NK cells, are administered every other day for 3 administrations per week. In one embodiment, the CAR-expressing cells, e.g., CAR T cells or CAR-expressing NK cells of the invention, are administered for at least two, three, four, five, six, seven, eight or more weeks.

In some embodiments, subjects may be adult subjects (i.e., 18 years of age and older). In certain embodiments, subjects may be between 1 and 30 years of age. In some embodiments, the subjects are 16 years of age or older. In certain embodiments, the subjects are between 16 and 30 years of age. In some embodiments, the subjects are child subjects (i.e., between 1 and 18 years of age).

In one aspect, CAR-expressing cells, e.g., CD20 CARTs, are generated using lentiviral viral vectors, such as lentivirus. CAR-expressing cells, e.g., CARTs, generated that way will have stable CAR expression.

In one aspect, CAR-expressing cells, e.g., CARTs, transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the cell, e.g., NK cell or T cell, by electroporation.

A potential issue that can arise in patients being treated using transiently expressing CAR T cells or CAR-expressing NK cells (particularly with murine scFv bearing CAR-expressing cells) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CART infusion breaks should not last more than ten to fourteen days.

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic.

Examples of suitable biopolymers include, but are not limited to, agar, agarose, alginate, alginate/calcium phosphate cement (CPC), beta-galactosidase (β-GAL), (1,2,3,4,6-pentaacetyl a-D-galactose), cellulose, chitin, chitosan, collagen, elastin, gelatin, hyaluronic acid collagen, hydroxyapatite, poly(3-hydroxybutyrate-co-3-hydroxyhexanoate) (PHBHHx), poly(lactide), poly(caprolactone) (PCL), poly(lactide-co-glycolide) (PLG), polyethylene oxide (PEO), poly(lactic-co-glycolic acid) (PLGA), polypropylene oxide (PPO), polyvinyl alcohol) (PVA), silk, soy protein, and soy protein isolate, alone or in combination with any other polymer composition, in any concentration and in any ratio. The biopolymer can be augmented or modified with adhesion- or migration-promoting molecules, e.g., collagen-mimetic peptides that bind to the collagen receptor of lymphocytes, and/or stimulatory molecules to enhance the delivery, expansion, or function, e.g., anti-cancer activity, of the cells to be delivered. The biopolymer scaffold can be an injectable, e.g., a gel or a semi-solid, or a solid composition.

In some embodiments, CAR-expressing cells described herein are seeded onto the biopolymer scaffold prior to delivery to the subject. In embodiments, the biopolymer scaffold further comprises one or more additional therapeutic agents described herein (e.g., another CAR-expressing cell, an antibody, or a small molecule) or agents that enhance the activity of a CAR-expressing cell, e.g., incorporated or conjugated to the biopolymers of the scaffold. In embodiments, the biopolymer scaffold is injected, e.g., intratumorally, or surgically implanted at the tumor or within a proximity of the tumor sufficient to mediate an anti-tumor effect. Additional examples of biopolymer compositions and methods for their delivery are described in Stephan et al., *Nature Biotechnology*, 2015, 33:97-101; and WO2014/110591.

CD20 CAR Constructs

Sequences useful for practicing the invention are disclosed in Table 1, Table 6, Table 11 and Table 14. Throughout the text of this application, should there be a discrepancy between the text of the specification (e.g., Table 1) and the sequence listing, the text of the specification shall prevail.

Anti-CD20 single chain variable fragments were isolated. See Table 1. Anti-CD20 ScFvs were cloned into lentiviral CAR expression vectors comprising the CD3zeta chain and the 4-1BB costimulatory molecule. See Table 14. The cloning method is further described in the Example section. The sequences of the CD20 CARs are provided below in Table 1. Each full CAR amino acid sequence in Table 1 includes an optional signal peptide sequence of 21 amino acids corresponding to the amino acid sequence: MALPVTALLL-PLALLLHAARP (SEQ ID NO: 1080). Each full CAR nucleotide sequence in Table 1 includes an optional nucleotide signal peptide sequence corresponding to the first 63 nucleotides corresponding to the nucleotide sequence:

(SEQ ID NO: 1081)
ATGGCCCTCCCTGTCACCGCCCTGCTGCTTCCGCTGGCTCTTCTGCTCCA

CGCCGCTCGGCCC.

TABLE 1

CD20 CAR Constructs

| SEQ ID NUMBER | Ab region | Sequence |
|---|---|---|
| CD20-C3H2 | | |
| SEQ ID NO: 136 (Kabat) | HCDR1 | NYNLH |
| SEQ ID NO: 137 (Kabat) | HCDR2 | AIYPGNYDTSYNQKFKG |
| SEQ ID NO: 138 (Kabat) | HCDR3 | VDFGHSRYWYFDV |
| SEQ ID NO: 139 (Chothia) | HCDR1 | GYTFTNY |
| SEQ ID NO: 140 (Chothia) | HCDR2 | YPGNYD |
| SEQ ID NO: 141 (Chothia) | HCDR3 | VDFGHSRYWYFDV |
| SEQ ID NO: 142 (IMGT) | HCDR1 | GYTFTNYN |
| SEQ ID NO: 143 (IMGT) | HCDR2 | IYPGNYDT |
| SEQ ID NO: 144 (IMGT) | HCDR3 | ARVDFGHSRYWYFDV |
| SEQ ID NO: 926 (Combined Chothia and Kabat) | HCDR1 | GYTFTNYNLH |
| SEQ ID NO: 927 (Combined Chothia and Kabat) | HCDR2 | AIYPGNYDTSYNQKFKG |
| SEQ ID NO: 928 (Combined Chothia and Kabat) | HCDR3 | VDFGHSRYWYFDV |
| SEQ ID NO: 145 | VH | QVQLVQSGAEVKKPGASVKVSCKASGYTFTNYNL HWVRQAPGQGLEWMGAIYPGNYDTSYNQKFKGR VTMTADKSTSTAYMELSSLRSEDTAVYYCARVDF GHSRYWYFDVWGQGTTVTVSS |
| SEQ ID NO: 146 | DNA VH | CAAGTCCAACTCGTCCAGTCCGGTGCAGAAGTC AAGAAACCTGGAGCATCCGTGAAAGTGTCTTGC AAAGCCTCCGGCTACACCTTCACCAACTACAACC TCCATTGGGTCAGACAGGCCCCCGGACAAGGAC TCGAATGGATGGGAGCGATCTACCCGGGAAACT ACGACACCAGCTACAACCAGAAGTTCAAGGGCC GCGTGACTATGACCGCCGATAAGAGCACCTCCA CCGCCTACATGGAACTGTCCTCGCTGAGGTCCGA GGACACTGCGGTGTACTACTGCGCCCGCGTGGA CTTCGGACACTCACGGTATTGGTACTTCGACGTC TGGGGACAGGGCACTACCGTGACCGTGTCGAGC |
| SEQ ID NO: 147 (Kabat) | LCDR1 | RATSSVSSMN |

TABLE 1-continued

CD20 CAR Constructs

| SEQ ID NUMBER | Ab region | Sequence |
|---|---|---|
| SEQ ID NO: 148 (Kabat) | LCDR2 | ATSNLAS |
| SEQ ID NO: 149 (Kabat) | LCDR3 | QQWTFNPPT |
| SEQ ID NO: 150 (Chothia) | LCDR1 | TSSVSS |
| SEQ ID NO: 151 (Chothia) | LCDR2 | ATS |
| SEQ ID NO: 152 (Chothia) | LCDR3 | WTFNPP |
| SEQ ID NO: 153 (IMGT) | LCDR1 | SSVSS |
| SEQ ID NO: 154 (IMGT) | LCDR2 | ATS |
| SEQ ID NO: 155 (IMGT) | LCDR3 | QQWTFNPPT |
| SEQ ID NO: 929 (Combined Chothia and Kabat) | LCDR1 | RATSSVSSMN |
| SEQ ID NO: 930 (Combined Chothia and Kabat) | LCDR2 | ATSNLAS |
| SEQ ID NO: 931 (Combined Chothia and Kabat) | LCDR3 | QQWTFNPPT |
| SEQ ID NO: 156 | VL | DIQLTQSPSFLSASVGDRVTITCRATSSVSSMNWYQ QKPGKAPKPLIHATSNLASGVPSRFSGSGSGTEYTL TISSLQPEDFATYYCQQWTFNPPTFGQGTKLEIK |
| SEQ ID NO: 157 | DNA VL | GATATCCAGCTGACTCAGTCCCCGTCATTCCTGT CCGCCTCCGTGGGAGACAGAGTGACCATCACCT GTCGGGCCACTTCCTCCGTGTCAAGCATGAACTG GTATCAGCAGAAGCCCGGGAAGGCCCCAAAGCC GCTGATTCACGCGACGTCCAACCTGGCTTCCGGC GTGCCGAGCCGGTTCTCCGGCTCGGGGAGCGGG ACTGAGTACACCCTGACTATTTCCTCGCTTCAAC CCGAGGACTTTGCTACCTACTACTGCCAACAGTG GACCTTCAATCCTCCGACATTCGGACAGGGTACC AAGTTGGAAATCAAG |
| SEQ ID NO: 158 | Linker | GGGGSGGGGSGGGGSGGGGS |
| SEQ ID NO: 159 | scFv (VH-linker-VL) | QVQLVQSGAEVKKPGASVKVSCKASGYTFTNYNL HWVRQAPGQGLEWMGAIYPGNYDTSYNQKFKGR VTMTADKSTSTAYMELSSLRSEDTAVYYCARVDF GHSRYWYFDVWGQGTTVTVSSGGGGSGGGGSGG GGSGGGGSDIQLTQSPSFLSASVGDRVTITCRATSS VSSMNWYQQKPGKAPKPLIHATSNLASGVPSRFSG SGSGTEYTLTISSLQPEDFATYYCQQWTFNPPTFGQ GTKLEIK |
| SEQ ID NO: 160 | DNA scFv (VH-linker-VL) | CAAGTCCAACTCGTCCAGTCCGGTGCAGAAGTCAAG AAACCTGGAGCATCCGTGAAAGTGTCTTGCAAAGCCT CCGGCTACACCTTCACCAACTACAACCTCCATTGGGT CAGACAGGCCCCCGGACAAGGTCGAATGGATGGG AGCGATCTACCCGGGAAACTACGACACCAGCTACAA CCAGAAGTTCAAGGGCCGCGTGACTATGACCGCCGA TAAGAGCACCTCCACCGCCTACATGGAACTGTCCTCG CTGAGGTCCGAGGACACTGCGGTGTACTACTGCGCCC GCGTGGACTTCGGACACTCACGGTATTGGTACTTCGA |

TABLE 1-continued

CD20 CAR Constructs

| SEQ ID NUMBER | Ab region | Sequence |
|---|---|---|
| | | CGTCTGGGGACAGGGCACTACCGTGACCGTGTCGAG<br>CGGCGGAGGAGGTTCGGGAGGGGGCGGATCAGGGG<br>GCGGCGGCAGCGGTGGAGGGGGCTCGGATATCCAGC<br>TGACTCAGTCCCCGTCATTCCTGTCCGCCTCCGTGGG<br>AGACAGAGTGACCATCACCTGTCGGGCCACTTCCTCC<br>GTGTCAAGCATGAACTGGTATCAGCAGAAGCCCGGG<br>AAGGCCCCAAAGCCGCTGATTCACGCGACGTCCAAC<br>CTGGCTTCCGGCGTGCCGAGCCGGTTCTCCGGCTCGG<br>GGAGCGGGACTGAGTACACCCTGACTATTTCCTCGCT<br>TCAACCCGAGGACTTTGCTACCTACTACTGCCAACAG<br>TGGACCTTCAATCCTCCGACATTCGGACAGGGTACCA<br>AGTTGGAAATCAAG |
| SEQ ID NO: 161 | Full CAR amino acid sequence | MALPVTALLLPLALLLHAARPQVQLVQSGAEVKK<br>PGASVKVSCKASGYTFTNYNLHWVRQAPGQGLE<br>WMGAIYPGNYDTSYNQKFKGRVTMTADKSTSTA<br>YMELSSLRSEDTAVYYCARVDFGHSRYWYFDVW<br>GQGTTVTVSSGGGGSGGGGSGGGGSGGGGSDIQL<br>TQSPSFLSASVGDRVTITCRATSSVSSMNWYQQKP<br>GKAPKPLIHATSNLASGVPSRFSGSGSGTEYTLTISS<br>LQPEDFATYYCQQWTFNPPTFGQGTKLEIKTTTPAP<br>RPPTPAPTIASQPLSLRPEACRPAAGGAVHTRGLDF<br>ACDIYIWAPLAGTCGVLLLSLVITLYCKRGRKKLL<br>YIFKQPFMRPVQTTQEEDGCSCRFPEEEEGGCELRV<br>KFSRSADAPAYQQGQNQLYNELNLGRREEYDVLD<br>KRRGRDPEMGGKPRRKNPQEGLYNELQKDKMAE<br>AYSEIGMKGERRRGKGHDGLYQGLSTATKDTYDA<br>LHMQALPPR |
| SEQ ID NO: 162 | Full CAR nucleic acid sequence | ATGGCCCTCCCTGTCACCGCCCTGCTGCTTCCGC<br>TGGCTCTTCTGCTCCACGCCGCTCGGCCCCAAGT<br>CCAACTCGTCCAGTCCGGTGCAGAAGTCAAGAA<br>ACCTGGAGCATCCGTGAAAGTGTCTTGCAAAGC<br>CTCCGGCTACACCTTCACCAACTACAACCTCCAT<br>TGGGTCAGACAGGCCCCCGGACAAGGACTCGAA<br>TGGATGGGAGCGATCTACCCGGGAAACTACGAC<br>ACCAGCTACAACCAGAAGTTCAAGGGCCGCGTG<br>ACTATGACCGCCGATAAGAGCACCTCCACCGCCT<br>ACATGGAACTGTCCTCGCTGAGGTCCGAGGACA<br>CTGCGGTGTACTACTGCGCCCGCGTGGACTTCGG<br>ACACTCACGGTATTGGTACTTCGACGTCTGGGGA<br>CAGGGCACTACCGTGACCGTGTCGAGCGGCGGA<br>GGAGGTTCGGGAGGGGGCGGATCAGGGGGCGGC<br>GGCAGCGGTGGAGGGGGCTCGGATATCCAGCTG<br>ACTCAGTCCCCGTCATTCCTGTCCGCCTCCGTGG<br>GAGACAGAGTGACCATCACCTGTCGGGCCACTT<br>CCTCCGTGTCAAGCATGAACTGGTATCAGCAGA<br>AGCCCGGGAAGGCCCCAAAGCCGCTGATTCACG<br>CGACGTCCAACCTGGCTTCCGGCGTGCCGAGCCG<br>GTTCTCCGGCTCGGGGAGCGGGACTGAGTACAC<br>CCTGACTATTTCCTCGCTTCAACCCGAGGACTTT<br>GCTACCTACTACTGCCAACAGTGGACCTTCAATC<br>CTCCGACATTCGGACAGGGTACCAAGTTGGAAA<br>TCAAGACCACTACCCCAGCACCGAGGCCACCCA<br>CCCCGGCTCCTACCATCGCCTCCCAGCCTCTGTC<br>CCTGCGTCCGGAGGCATGTAGACCCGCAGCTGG<br>TGGGGCCGTGCATACCCGGGGTCTTGACTTCGCC<br>TGCGATATCTACATTTGGGCCCCTCTGGCTGGTA<br>CTTGCGGGGTCCTGCTGCTTTCACTCGTGATCAC<br>TCTTTACTGTAAGCGCGGTCGGAAGAAGCTGCTG<br>TACATCTTTAAGCAACCCTTCATGAGGCCTGTGC<br>AGACTACTCAAGAGGAGGACGGCTGTTCATGCC<br>GGTTCCCAGAGGAGGAGGAAGGCGGCTGCGAAC<br>TGCGCGTGAAATTCAGCCGCAGCGCAGATGCTC<br>CAGCCTACCAGCAGGGGCAGAACCAGCTCTACA<br>ACGAACTCAATCTTGGTCGGAGAGAGGAGTACG<br>ACGTGCTGGACAAGCGGAGAGGACGGGACCCAG<br>AAATGGGCGGGAAGCCGCGCAGAAAGAATCCCC<br>AAGAGGGCCTGTACAACGAGCTCCAAAAGGATA<br>AGATGGCAGAAGCCTATAGCGAGATTGGTATGA<br>AGGGGAACGCAGAAGAGGCAAAGGCCACGAC<br>GGACTGTACCAGGGACTCAGCACCGCCACCAAG<br>GACACCTATGACGCTCTTCACATGCAGGCCCTGC<br>CGCCTCGG |

TABLE 1-continued

CD20 CAR Constructs

| SEQ ID NUMBER | Ab region | Sequence |
|---|---|---|
| CD20-C5H1 | | |
| SEQ ID NO: 217 (Kabat) | HCDR1 | SYNMH |
| SEQ ID NO: 218 (Kabat) | HCDR2 | AIYPGNGDTSYNPKFKG |
| SEQ ID NO: 219 (Kabat) | HCDR3 | SYFYGSSSWYFDV |
| SEQ ID NO: 220 (Chothia) | HCDR1 | GYTFTSY |
| SEQ ID NO: 221 (Chothia) | HCDR2 | YPGNGD |
| SEQ ID NO: 222 (Chothia) | HCDR3 | SYFYGSSSWYFDV |
| SEQ ID NO: 223 (IMGT) | HCDR1 | GYTFTSYN |
| SEQ ID NO: 224 (IMGT) | HCDR2 | IYPGNGDT |
| SEQ ID NO: 225 (IMGT) | HCDR3 | ARSYFYGSSSWYFDV |
| SEQ ID NO: 941 (Combined Chothia and Kabat) | HCDR1 | GYTFTSYNMH |
| SEQ ID NO: 942 (Combined Chothia and Kabat) | HCDR2 | AIYPGNGDTSYNPKFKG |
| SEQ ID NO: 943 (Combined Chothia and Kabat) | HCDR3 | SYFYGSSSWYFDV |
| SEQ ID NO: 226 | VH | QVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSS |
| SEQ ID NO: 227 | DNA VH | CAAGTGCAGCTCGTCCAGTCCGGTGCAGAAGTCAAGAAACCCGGTGCTTCAGTGAAAGTGTCCTGCAAGGCCTCCGGTTACACCTTCACCTCCTACAACATGCACTGGGTCCGCCAAGCCCCGGGCCAGGGACTCGAATGGATGGGAGCCATCTACCCTGGCAACGGGGACACCTCATACAACCCTAAGTTCAAGGGCAGAGTGACCATGACTGCGGACAAGTCCACTAGAACAGCGTACATGGAGCTGAGCAGCCTGCGGTCCGAGGATACTGCCGTGTACTACTGCGCCCGCTCCTACTTCTACGGAAGCTCGTCGTGGTACTTCGATGTCTGGGGACAGGGCACCACTGTGACTGTGTCCTCC |
| SEQ ID NO: 228 (Kabat) | LCDR1 | RASSSVSSMH |
| SEQ ID NO: 229 (Kabat) | LCDR2 | ATSNLAS |
| SEQ ID NO: 230 (Kabat) | LCDR3 | QQWIFNPPT |
| SEQ ID NO: 231 (Chothia) | LCDR1 | SSSVSS |
| SEQ ID NO: 232 (Chothia) | LCDR2 | ATS |

TABLE 1-continued

CD20 CAR Constructs

| SEQ ID NUMBER | Ab region | Sequence |
|---|---|---|
| SEQ ID NO: 233 (Chothia) | LCDR3 | WIFNPP |
| SEQ ID NO: 234 (IMGT) | LCDR1 | SSVSS |
| SEQ ID NO: 235 (IMGT) | LCDR2 | ATS |
| SEQ ID NO: 236 (IMGT) | LCDR3 | QQWIFNPPT |
| SEQ ID NO: 944 (Combined Chothia and Kabat) | LCDR1 | RASSSVSSMH |
| SEQ ID NO: 945 (Combined Chothia and Kabat) | LCDR2 | ATSNLAS |
| SEQ ID NO: 988 (Combined Chothia and Kabat) | LCDR3 | QQWIFNPPT |
| SEQ ID NO: 237 | VL | EIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK |
| SEQ ID NO: 238 | DNA VL | GAAATTGTGCTGACTCAGAGCCCCGCCACCCTGAGCTTGTCCCCCGGGGAAAGGGCAACGCTGTCATGCCGCGCCTCGTCATCCGTGTCCTCCATGCATTGGTACCAGCAGAAGCCGGGACAGGCCCCTCGGCCGCTGATCTTCGCCACCTCCAATCTCGCTTCCGGCATTCCGGCCCGGTTCTCGGGAAGCGGGTCGGGGACCGACTATACCCTGACCATCTCTAGCCTTGAACCTGAGGACGCCGCGGTGTACTATTGTCAACAGTGGATCTTTAACCCCCCAACCTTCGGTGGAGGCACCAAAGTGGAGATTAAG |
| SEQ ID NO: 239 | Linker | GGGGSGGGGSGGGGSGGGGS |
| SEQ ID NO: 240 | scFv (VH-linker-VL) | QVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK |
| SEQ ID NO: 241 | DNA scFv (VH-linker-VL) | CAAGTGCAGCTCGTCCAGTCCGGTGCAGAAGTCAAGAAACCCGGTGCTTCAGTGAAAGTGTCCTGCAAGGCCTCCGGTTACACCTTCACCTCCTACAACATGCACTGGGTCCGCCAAGCCCCGGGCCAGGGACTCGAATGGATGGGAAGCCATCTACCCTGGCAACGGGGACACCTCATACAACCCTAAGTTCAAGGGCAGAGTGACCATGACTGCGGACAAGTCCACTAGAACAGCGTACATGGAGCTGAGCAGCCTGCGGTCCGAGGATACTGCCGTGTACTACTGCGCCCGCTCCTACTTCTACGGAAGCTCGTCGTGGTACTTCGATGTCTGGGGACAGGGCACCACTGTGACTGTGTCCTCCGGTGGCGGAGGCTCGGGCGGAGGCGGAAGCGGCGGCGGGGGATCGGAGGAGGAGGGTCCGAAATTGTGCTGACTCAGAGCCCCGCCACCCTGAGCTTGTCCCCCGGGGAAAGGGCAACGCTGTCATGCCGCGCCTCGTCATCCGTGTCCTCCATGCATTGGTACCAGCAGAAGCGGGACAGGCCCCTCGGCCGCTGATCTTCGCCACCTCCAATCTCGCTTCCGGCATTCGGCCCGGTTCTCGGGAAGCGGGTCGGGGACCGACTATACCCTGACCATCTCTAGCCTTGAACCTGAGGACGCCGCGGTGTACTATTGTCAACAGTGG |

TABLE 1-continued

CD20 CAR Constructs

| SEQ ID NUMBER | Ab region | Sequence |
|---|---|---|
|  |  | ATCTTTAACCCCCCAACCTTCGGTGGAGGCACCAAAG<br>TGGAGATTAAG |
| SEQ ID NO: 242 | Full CAR amino acid sequence | MALPVTALLLPLALLLHAARPQVQLVQSGAEVKK<br>PGASVKVSCKASGYTFTSYNMHWVRQAPGQGLE<br>WMGAIYPGNGDTSYNPKFKGRVTMTADKSTRTAY<br>MELSSLRSEDTAVYYCARSYFYGSSSWYFDVWGQ<br>GTTVTVSSGGGGSGGGGSGGGGSEIVLTQS<br>PATLSLSPGERATLSCRASSSVSSMHWYQQKPGQA<br>PRPLIFATSNLASGIPARFSGSGSGTDYTLTISSLEPE<br>DAAVYYCQQWIFNPPTFGGGTKVEIKTTTPAPRPPT<br>PAPTIASQPLSLRPEACRPAAGGAVHTRGLDFACDI<br>YIWAPLAGTCGVLLLSLVITLYCKRGRKKLLYIFKQ<br>PFMRPVQTTQEEDGCSCRFPEEEEGGCELRVKFSRS<br>ADAPAYQQGQNQLYNELNLGRREEYDVLDKRRG<br>RDPEMGGKPRRKNPQEGLYNELQKDKMAEAYSEI<br>GMKGERRRGKGHDGLYQGLSTATKDTYDALHMQ<br>ALPPR |
| SEQ ID NO: 243 | Full CAR nucleic acid sequence | ATGGCCCTCCCTGTCACCGCCCTGCTGCTTCCGC<br>TGGCTCTTCTGCTCCACGCCGCTCGGCCCCAAGT<br>GCAGCTCGTCCAGTCCGGTGCAGAAGTCAAGAA<br>ACCCGGTGCTTCAGTGAAAGTGTCCTGCAAGGCC<br>TCCGGTTACACCTTCACCTCCTACAACATGCACT<br>GGGTCCGCCAAGCCCGGGCCAGGGACTCGAAT<br>GGATGGGAGCCATCTACCCTGGCAACGGGGACA<br>CCTCATACAACCCTAAGTTCAAGGGCAGAGTGA<br>CCATGACTGCGGACAAGTCCACTAGAACAGCGT<br>ACATGGAGCTGAGCAGCCTGCGGTCCGAGGATA<br>CTGCCGTGTACTACTGCGCCCGCTCCTACTTCTA<br>CGGAAGCTCGTCGTGGTACTTCGATGTCTGGGGA<br>CAGGGCACCACTGTGACTGTGTCCTCCGGTGGCG<br>GAGGCTCGGGCGGAGGCGGAAGCGGCGGCGGG<br>GGATCGGGAGGAGGAGGGTCCGAAATTGTGCTG<br>ACTCAGAGCCCCGCCACCCTGAGCTTGTCCCCCG<br>GGGAAAGGGCAACGCTGTCATGCCGCGCCTCGT<br>CATCCGTGTCCTCCATGCATTGGTACCAGCAGAA<br>GCCGGGACAGGCCCCTCGGCCGCTGATCTTCGCC<br>ACCTCCAATCTCGCTTCCGGCATTCCGGCCCGGT<br>TCTCGGGAAGCGGGTCGGGGACCGACTATACCC<br>TGACCATCTCTAGCCTTGAACCTGAGGACGCCGC<br>GGTGTACTATTGTCAACAGTGGATCTTTAACCCC<br>CCAACCTTCGGTGGAGGCACCAAAGTGGAGATT<br>AAGACCACTACCCCAGCACCGAGGCCACCCACC<br>CCGGCTCCTACCATCGCCTCCCAGCCTCTGTCCC<br>TGCGTCCGGAGGCATGTAGACCCGCAGCTGGTG<br>GGGCCGTGCATACCCGGGGTCTTGACTTCGCCTG<br>CGATATCTACATTTGGGCCCCTCTGGCTGGTACT<br>TGCGGGGTCCTGCTGCTTTCACTCGTGATCACTC<br>TTTACTGTAAGCGCGGTCGGAAGAAGCTGCTGTA<br>CATCTTTAAGCAACCCTTCATGAGGCCTGTGCAG<br>ACTACTCAAGAGGAGGACGGCTGTTCATGCCGG<br>TTCCCAGAGGAGGAGGAAGGCGGCTGCGAACTG<br>CGCGTGAAATTCAGCCGCAGCGCAGATGCTCCA<br>GCCTACCAGCAGGGGCAGAACCAGCTCTACAAC<br>GAACTCAATCTTGGTCGGAGAGAGGAGTACGAC<br>GTGCTGGACAAGCGGAGAGGACGGGACCCAGAA<br>ATGGGCGGGAAGCCGCGCAGAAAGAATCCCCAA<br>GAGGGCCTGTACAACGAGCTCCAAAAGGATAAG<br>ATGGCAGAAGCCTATAGCGAGATTGGTATGAAA<br>GGGGAACGCAGAAGAGGCAAAGGCCACGACGG<br>ACTGTACCAGGGACTCAGCGCCACCAAGGA<br>CACCTATGACGCTCTTCACATGCAGGCCCTGCCG<br>CCTCGG |

CD20-C2H1

| SEQ ID NO: 1 (Kabat) | HCDR1 | NYWMH |
| SEQ ID NO: 2 (Kabat) | HCDR2 | FITPTTGYPEYNQKFKD |
| SEQ ID NO: 3 (Kabat) | HCDR3 | RKVGKGVYYALDY |

TABLE 1-continued

CD20 CAR Constructs

| SEQ ID NUMBER | Ab region | Sequence |
|---|---|---|
| SEQ ID NO: 4 (Chothia) | HCDR1 | GYTFTNY |
| SEQ ID NO: 5 (Chothia) | HCDR2 | TPTTGY |
| SEQ ID NO: 6 (Chothia) | HCDR3 | RKVGKGVYYALDY |
| SEQ ID NO: 7 (IMGT) | HCDR1 | GYTFTNYW |
| SEQ ID NO: 8 (IMGT) | HCDR2 | ITPTTGYP |
| SEQ ID NO: 9 (IMGT) | HCDR3 | ARRKVGKGVYYALDY |
| SEQ ID NO: 896 (Combined Chothia and Kabat) | HCDR1 | GYTFTNYWMH |
| SEQ ID NO: 897 (Combined Chothia and Kabat) | HCDR2 | FITPTTGYPEYNQKFKD |
| SEQ ID NO: 898 (Combined Chothia and Kabat) | HCDR3 | RKVGKGVYYALDY |
| SEQ ID NO: 10 | VH | QVQLVQSGAEVKKPGASVKVSCKASGYTFTNYW MHWVRQAPGQGLEWMGFITPTTGYPEYNQKFKD RVTMTADKSTSTAYMELSSLRSEDTAVYYCARRK VGKGVYYALDYWGQGTTVTVSS |
| SEQ ID NO: 11 | DNA VH | CAAGTGCAACTCGTCCAGTCCGGTGCAGAAGTC AAGAAACCAGGCGCATCCGTGAAAGTCTCCTGC AAAGCCTCCGGCTACACATTCACTAACTATTGGA TGCATTGGGTGCGCCAGGCCCCGGGACAGGGGC TGGAGTGGATGGGGTTCATTACCCCTACCACCGG CTACCCTGAGTACAACCAGAAGTTCAAGGATAG GGTCACCATGACCGCTGACAAGTCCACCTCCACC GCGTACATGGAACTGTCATCGCTCCGGTCCGAGG ATACCGCGGTGTACTACTGCGCCCGGAGAAAAG TCGGAAAGGGAGTGTATTACGCCTTGGACTACTG GGGACAGGGGACTACCGTGACCGTGTCGAGC |
| SEQ ID NO: 12 (Kabat) | LCDR1 | RASGNIHNYLA |
| SEQ ID NO: 13 (Kabat) | LCDR2 | NTKTLAD |
| SEQ ID NO: 14 (Kabat) | LCDR3 | QHFWSSPWT |
| SEQ ID NO: 15 (Chothia) | LCDR1 | SGNIHNY |
| SEQ ID NO: 16 (Chothia) | LCDR2 | NTK |
| SEQ ID NO: 17 (Chothia) | LCDR3 | FWSSPW |
| SEQ ID NO: 18 (IMGT) | LCDR1 | GNIHNY |
| SEQ ID NO: 19 (IMGT) | LCDR2 | NTK |

TABLE 1-continued

CD20 CAR Constructs

| SEQ ID NUMBER | Ab region | Sequence |
|---|---|---|
| SEQ ID NO: 20 (IMGT) | LCDR3 | QHFWSSPWT |
| SEQ ID NO: 899 (Combined Chothia and Kabat) | LCDR1 | RASGNIHNYLA |
| SEQ ID NO: 900 (Combined Chothia and Kabat) | LCDR2 | NTKTLAD |
| SEQ ID NO: 901 (Combined Chothia and Kabat) | LCDR3 | QHFWSSPWT |
| SEQ ID NO: 21 | VL | DIQMTQSPSSLSASVGDRVTITCRASGNIHNYLAW YQQKPGKVPKLLIYNTKTLADGVPSRFSGSGSGTD YTLTISSLQPEDVATYYCQHFWSSPWTFGGGTKVE IK |
| SEQ ID NO: 22 | DNA VL | GACATCCAGATGACCCAGTCCCCGTCAAGCCTTA GCGCCTCCGTGGGCGACCGCGTGACCATTACTTG TCGGGCGTCGGGAAACATCCACAACTACCTCGC CTGGTACCAGCAGAAGCCGGGAAAGGTCCCCAA GCTGCTGATCTACAATACCAAGACTCTGGCCGAC GGAGTGCCTTCCCGCTTTTCCGGTTCGGGAAGCG GGACTGACTACACCCTGACTATCTCCTCGCTGCA ACCCGAAGATGTGGCTACGTACTACTGCCAGCA CTTCTGGTCCTCTCCCTGGACCTTCGGCGGTGGC ACTAAGGTCGAGATTAAG |
| SEQ ID NO: 23 | Linker | GGGGSGGGGSGGGGSGGGGS |
| SEQ ID NO: 24 | scFv (VH-linker-VL) | QVQLVQSGAEVKKPGASVKVSCKASGYTFTNYW MHWVRQAPGQGLEWMGFITPTTGYPEYNQKFKD RVTMTADKSTSTAYMELSSLRSEDTAVYYCARRK VGKGVYYALDYWGQGTTVTVSSGGGGSGGGGSG GGGSGGGGSDIQMTQSPSSLSASVGDRVTITCRAS GNIHNYLAWYQQKPGKVPKLLIYNTKTLADGVPS RFSGSGSGTDYTLTISSLQPEDVATYYCQHFWSSP WTFGGGTKVEIK |
| SEQ ID NO: 25 | DNA scFv (VH-linker-VL) | CAAGTGCAACTCGTCCAGTCCGGTGCAGAAGTCAAG AAACCAGGCGCATCCGTGAAAGTCTCCTGCAAAGCC TCCGGCTACACATTCACTAACTATTGGATGCATTGG GTGCGCCAGGCCCCGGGACAGGGGCTGGAGTGGATGG GGTTCATTACCCCTACCACCGGCTACCCTGAGTACAA CCAGAAGTTCAAGGATAGGGTCACCATGACCGCTGA CAAGTCCACCTCCACCGCGTACATGGAACTGTCATCG CTCCGGTCCGAGGATACCGCGGTGTACTACTGCGCCC GGAGAAAAGTCGGAAAGGGAGTGTATTACGCCTTGG ACTACTGGGGACAGGGGACTACCGTGACCGTGTCGA GCGGTGGAGGCGGCTCCGGCGGAGGAGGAAGCGGG GGAGGCGGTTCAGGGGGCGGAGGAAGCGGACATCCAG ATGACCCAGTCCCCGTCAAGCCTTAGCGCCTCCGTGG GCGACCGCGTGACCATTACTTGTCGGGCGTCGGAA ACATCCACAACTACCTCGCCTGGTACCAGCAGAAGCC GGGAAAGGTCCCCAAGCTGCTGATCTACAATACCAA GACTCTGGCCGACGGAGTGCCTTCCCGCTTTTCCGGT TCGGGAAGCGGGACTGACTACACCCTGACTATCTCCT CGCTGCAACCCGAAGATGTGGCTACGTACTACTGCCA GCACTTCTGGTCCTCTCCCTGGACCTTCGGCGGTGGC ACTAAGGTCGAGATTAAG |
| SEQ ID NO: 26 | Full CAR amino acid sequence | MALPVTALLLPLALLLHAARPQVQLVQSGAEVKK PGASVKVSCKASGYTFTNYMHWVRQAPGQGLE WMGFITPTTGYPEYNQKFKDRVTMTADKSTSTAY MELSSLRSEDTAVYYCARRKVGKGVYYALDYWG QGTTVTVSSGGGGSGGGGSGGGGSGGGGSDIQMT QSPSSLSASVGDRVTITCRASGNIHNYLAWYQQKP GKVPKLLIYNTKTLADGVPSRFSGSGSGTDYTLTIS |

TABLE 1-continued

CD20 CAR Constructs

| SEQ ID NUMBER | Ab region | Sequence |
|---|---|---|
| | | SLQPEDVATYYCQHFWSSPWTFGGGTKVEIKTTTP APRPPTPAPTIASQPLSLRPEACRPAAGGAVHTRGL DFACDIYIWAPLAGTCGVLLLSLVITLYCKRGRKK LLYIFKQPFMRPVQTTQEEDGCSCRFPEEEEGGCEL RVKFSRSADAPAYQQGQNQLYNELNLGRREEYDV LDKRRGRDPEMGGKPRRKNPQEGLYNELQKDKM AEAYSEIGMKGERRRGKGHDGLYQGLSTATKDTY DALHMQALPPR |
| SEQ ID NO: 27 | Full CAR nucleic acid sequence | ATGGCCCTCCCTGTCACCGCCCTGCTGCTTCCGC TGGCTCTTCTGCTCCACGCCGCTCGGCCCCCAAGT GCAACTCGTCCAGTCCGGTGCAGAAGTCAAGAA ACCAGGCGCATCCGTGAAAGTCTCCTGCAAAGC CTCCGGCTACACATTCACTAACTATTGGATGCAT TGGGTGCGCCAGGCCCCGGGACAGGGGCTGGAG TGGATGGGGTTCATTACCCCTACCACCGGCTACC CTGAGTACAACCAGAAGTTCAAGGATAGGGTCA CCATGACCGCTGACAAGTCCACCTCCACCGCGTA CATGGAACTGTCATCGCTCCGGTCCGAGGATACC GCGGTGTACTACTGCGCCCGGAGAAAAGTCGGA AAGGGAGTGTATTACGCCTTGGACTACTGGGGA CAGGGGACTACCGTGACCGTGTCGAGCGGTGGA GGCGGCTCCGGCGGAGGAGGAAGCGGGGGAGG CGGTTCAGGGGGCGGAGGAAGCGACATCCAGAT GACCCAGTCCCCGTCAAGCCTTAGCGCCTCCGTG GGCGACCGCGTGACCATTACTTGTCGGGCGTCGG GAAACATCCACAACTACCTCGCCTGGTACCAGC AGAAGCCGGGAAAGGTCCCCAAGCTGCTGATCT ACAATACCAAGACTCTGGCCGACGGAGTGCCTT CCCGCTTTTCCGGTTCGGGAAGCGGGACTGACTA CACCCTGACTATCTCCTCGCTGCAACCCGAAGAT GTGGCTACGTACTACTGCCAGCACTTCTGGTCCT CTCCCTGGACCTTCGGCGGTGGCACTAAGGTCGA GATTAAGACCACTACCCCAGCACCGAGGCCACC CACCCCGGCTCCTACCATCGCCTCCCAGCCTCTG TCCCTGCGTCCGGAGGCATGTAGACCCGCAGCTG GTGGGGCCGTGCATACCCGGGGTCTTGACTTCGC CTGCGATATCTACATTTGGGCCCCTCTGGCTGGT ACTTGCGGGGTCCTGCTGCTTTCACTCGTGATCA CTCTTTACTGTAAGCGCGGTCGGAAGAAGCTGCT GTACATCTTTAAGCAACCCTTCATGAGGCCTGTG CAGACTACTCAAGAGGAGGACGGCTGTTCATGC CGGTTCCCAGAGGAGGAGGAAGGCGGCTGCGAA CTGCGCGTGAAATTCAGCCGCAGCGCAGATGCT CCAGCCTACCAGCAGGGGCAGAACCAGCTCTAC AACGAACTCAATCTTGGTCGGAGAGAGGAGTAC GACGTGCTGGACAAGCGGAGGAGGACGGGACCCA GAAATGGGCGGAAGCCGCGCAGAAAGAATCCC CAAGAGGGCCTGTACAACGAGCTCCAAAAGGAT AAGATGGCAGAAGCCTATAGCGAGATTGGTATG AAAGGGGAACGCAGAAGAGGCAAAGGCCACGA CGGACTGTACCAGGGACTCAGCACCGCCACCAA GGACACCTATGACGCTCTTCACATGCAGGCCCTG CCGCCTCGG |

CD20-C2H2

| SEQ ID NO: 28 (Kabat) | HCDR1 | NYWMH |
| SEQ ID NO: 29 (Kabat) | HCDR2 | FITPTTGYPEYNQKFKD |
| SEQ ID NO: 30 (Kabat) | HCDR3 | RKVGKGVYYALDY |
| SEQ ID NO: 31 (Chothia) | HCDR1 | GYTFTNY |
| SEQ ID NO: 32 (Chothia) | HCDR2 | TPTTGY |
| SEQ ID NO: 33 (Chothia) | HCDR3 | RKVGKGVYYALDY |
| SEQ ID NO: 34 (IMGT) | HCDR1 | GYTFTNYW |

TABLE 1-continued

CD20 CAR Constructs

| SEQ ID NUMBER | Ab region | Sequence |
|---|---|---|
| SEQ ID NO: 35 (IMGT) | HCDR2 | ITPTTGYP |
| SEQ ID NO: 36 (IMGT) | HCDR3 | ARRKVGKGVYYALDY |
| SEQ ID NO: 902 (Combined Chothia and Kabat) | HCDR1 | GYTFTNYWMH |
| SEQ ID NO: 903 (Combined Chothia and Kabat) | HCDR2 | FITPTTGYPEYNQKFKD |
| SEQ ID NO: 904 (Combined Chothia and Kabat) | HCDR3 | RKVGKGVYYALDY |
| SEQ ID NO: 37 | VH | QVQLVQSGAEVKKPGSSVKVSCKASGYTFTNYW MHWVRQAPGQGLEWMGFITPTTGYPEYNQKFKD RVTITADKSTSTAYMELSSLRSEDTAVYYCARRKV GKGVYYALDYWGQGTTVTVSS |
| SEQ ID NO: 38 | DNA VH | CAAGTCCAACTCGTCCAATCAGGAGCAGAAGTC AAGAAGCCCGGAAGCTCTGTCAAAGTGTCCTGC AAGGCCTCCGGTTACACCTTCACCAACTATTGGA TGCACTGGGTCAGACAGGCCCCGGGACAGGGCT TGGAATGGATGGGTTTCATCACTCCAACCACCGG TTACCCGGAGTACAACCAGAAGTTTAAGGACCG CGTGACCATTACTGCCGACAAGTCCACGAGCAC CGCTTACATGGAACTTAGCAGCCTGCGGTCCGAG GACACTGCCGTGTATTACTGCGCGCGGAGGAAG GTCGGAAAGGGAGTGTACTACGCACTGGACTAC TGGGGCCAGGGAACCACCGTGACTGTGTCCTCC |
| SEQ ID NO: 39 (Kabat) | LCDR1 | RASGNIHNYLA |
| SEQ ID NO: 40 (Kabat) | LCDR2 | NTKTLAD |
| SEQ ID NO: 41 (Kabat) | LCDR3 | QHFWSSPWT |
| SEQ ID NO: 42 (Chothia) | LCDR1 | SGNIHNY |
| SEQ ID NO: 43 (Chothia) | LCDR2 | NTK |
| SEQ ID NO: 44 (Chothia) | LCDR3 | FWSSPW |
| SEQ ID NO: 45 (IMGT) | LCDR1 | GNIHNY |
| SEQ ID NO: 46 (IMGT) | LCDR2 | NTK |
| SEQ ID NO: 47 (IMGT) | LCDR3 | QHFWSSPWT |
| SEQ ID NO: 905 (Combined Chothia and Kabat) | LCDR1 | RASGNIHNYLA |
| SEQ ID NO: 906 (Combined Chothia and Kabat) | LCDR2 | NTKTLAD |

TABLE 1-continued

CD20 CAR Constructs

| SEQ ID NUMBER | Ab region | Sequence |
|---|---|---|
| SEQ ID NO: 907 (Combined Chothia and Kabat) | LCDR3 | QHFWSSPWT |
| SEQ ID NO: 48 | VL | DIQMTQSPSSLSASVGDRVTITCRASGNIHNYLAW YQQKPGKVPKLLIYNTKTLADGVPSRFSGSGSGTD YTLTISSLQPEDVATYYCQHFWSSPWTFGGGTKVE IK |
| SEQ ID NO: 49 | DNA VL | GATATTCAGATGACCCAGTCCCCTTCATCCCTGA GCGCCTCAGTGGGCGATAGAGTGACCATCACTT GTCGCGCCTCGGGCAATATCCACAACTACCTCGC CTGGTACCAGCAGAAGCCGGGAAAAGTGCCTAA GCTGCTGATCTACAACACTAAGACCCTGGCGGAT GGAGTGCCCAGCCGGTTCTCCGGCTCCGGCAGC GGCACAGACTACACCCTCACCATCTCCTCGCTGC AACCAGAGGACGTGGCTACCTACTACTGCCAGC ATTTCTGGTCGTCCCCCTGGACTTTCGGAGGGGG GACCAAAGTGGAGATTAAG |
| SEQ ID NO: 50 | Linker | GGGGSGGGGSGGGGSGGGGS |
| SEQ ID NO: 51 | scFv (VH-linker-VL) | QVQLVQSGAEVKKPGSSVKVSCKASGYTFTNYW MHWVRQAPGQGLEWMGFITPTTGYPEYNQKFKD RVTITADKSTSTAYMELSSLRSEDTAVYYCARRKV GKGVYYALDYWGQGTTVTVSSGGGGSGGGGSGG GGSGGGGSDIQMTQSPSSLSASVGDRVTITCRASG NIHNYLAWYQQKPGKVPKLLIYNTKTLADGVPSRF SGSGSGTDYTLTISSLQPEDVATYYCQHFWSSPWT FGGGTKVEIK |
| SEQ ID NO: 52 | DNA scFv (VH-linker-VL) | CAAGTCCAACTCGTCCAATCAGGAGCAGAAGTCAAG AAGCCCGGAAGCTCTGTCAAAGTGTCCTGCAAGGCCT CCGGTTACACCTTCACCAACTATTGGATGCACTGGGT CAGACAGGCCCCGGGACAGGGCTTGGAATGGATGGG TTTCATCACTCCAACCACCGGTTACCCGGAGTACAAC CAGAAGTTTAAGGACCGCGTGACCATTACTGCCGAC AAGTCCACGAGCACCGCTTACATGGAACTTAGCAGC CTGCGGTCCGAGGACACTGCCGTGTATTACTGCGCGC GGAGGAAGGTCGGAAAGGGAGTGTACTACGCACTGG ACTACTGGGGCCAGGGAACCACCGTGACTGTGTCCTC CGGTGGCGGAGGGTCGGGAGGGGGGGCTCGGGAG GAGGAGGGTCCGGGGGCGGTGGCTCAGATATTCAGA TGACCCAGTCCCCTTCATCCCTGAGCGCCTCAGTGGG CGATAGAGTGACCATCACTTGTCGCGCCTCGGGCAAT ATCCACAACTACCTCGCCTGGTACCAGCAGAAGCCG GGAAAAGTGCCTAAGCTGCTGATCTACAACACTAAG ACCCTGGCGGATGGAGTGCCCAGCCGGTTCTCCGGCT CCGGCAGCGGCACAGACTACACCCTCACCATCTCCTC GCTGCAACCAGAGGACGTGGCTACCTACTACTGCCA GCATTTCTGGTCGTCCCCCTGGACTTTCGGAGGGGGG ACCAAAGTGGAGATTAAG |
| SEQ ID NO: 53 | Full CAR amino acid sequence | MALPVTALLLPLALLLHAARPQVQLVQSGAEVKK PGSSVKVSCKASGYTFTNYWMHWVRQAPGQGLE WMGFITPTTGYPEYNQKFKDRVTITADKSTSTAYM ELSSLRSEDTAVYYCARRKVGKGVYYALDYWGQ GTTVTVSSGGGGSGGGGSGGGGSGGGGSDIQMTQ SPSSLSASVGDRVTITCRASGNIHNYLAWYQQKPG KVPKLLIYNTKTLADGVPSRFSGSGSGTDYTLTISS LQPEDVATYYCQHFWSSPWTFGGGTKVEIKTTTPA PRPPTPAPTIASQPLSLRPEACRPAAGGAVHTRGLD FACDIYIWAPLAGTCGVLLLSLVITLYCKRGRKKLL YIFKQPFMRPVQTTQEEDGCSCRFPEEEEGGCELRV KFSRSADAPAYQQGQNQLYNELNLGRREEYDVLD KRRGRDPEMGGKPRRKNPQEGLYNELQKDKMAE AYSEIGMKGERRRGKGHDGLYQGLSTATKDTYDA LHMQALPPR |
| SEQ ID NO: 54 | Full CAR nucleic acid sequence | ATGGCCCTCCCTGTCACCGCCCTGCTGCTTCCGC TGGCTCTTCTGCTCCACGCCGCTCGGCCCCAAGT CCAACTCGTCCAATCAGGAGCAGAAGTCAAGAA GCCCGGAAGCTCTGTCAAAGTGTCCTGCAAGGC |

TABLE 1-continued

CD20 CAR Constructs

| SEQ ID NUMBER | Ab region | Sequence |
|---|---|---|
| | | CTCCGGTTACACCTTCACCAACTATTGGATGCAC
TGGGTCAGACAGGCCCCGGGACAGGGCTTGGAA
TGGATGGGTTTCATCACTCCAACCACCGGTTACC
CGGAGTACAACCAGAAGTTTAAGGACCGCGTGA
CCATTACTGCCGACAAGTCCACGAGCACCGCTTA
CATGGAACTTAGCAGCCTGCGGTCCGAGGACAC
TGCCGTGTATTACTGCGCGCGGAGGAAGGTCGG
AAAGGGAGTGTACTACGCACTGGACTACTGGGG
CCAGGGAACCACCGTGACTGTGTCCTCCGGTGGC
GGAGGGTCGGGAGGGGGGGGCTCGGGAGGAGG
AGGGTCCGGGGCGGTGGCTCAGATATTCAGAT
GACCCAGTCCCCTTCATCCCTGAGCGCCTCAGTG
GGCGATAGAGTGACCATCACTTGTCGCGCCTCGG
GCAATATCCACAACTACCTCGCCTGGTACCAGCA
GAAGCCGGGAAAAGTGCCTAAGCTGCTGATCTA
CAACACTAAGACCCTGGCGGATGGAGTGCCCAG
CCGGTTCTCCGGCTCCGGCAGCGGCACAGACTAC
ACCCTCACCATCTCCTCGCTGCAACCAGAGGACG
TGGCTACCTACTACTGCCAGCATTTCTGGTCGTC
CCCCTGGACTTTCGGAGGGGGGACCAAAGTGGA
GATTAAGACCACTACCCCAGCACCGAGGCCACC
CACCCCGGCTCCTACCATCGCCTCCCAGCCTCTG
TCCCTGCGTCCGGAGGCATGTAGACCCGCAGCTG
GTGGGGCCGTGCATACCCGGGGTCTTGACTTCGC
CTGCGATATCTACATTTGGGCCCCTCTGGCTGGT
ACTTGCGGGGTCCTGCTGCTTTCACTCGTGATCA
CTCTTTACTGTAAGCGCGGTCGGAAGAAGCTGCT
GTACATCTTTAAGCAACCCTTCATGAGGCCTGTG
CAGACTACTCAAGAGGAGGACGGCTGTTCATGC
CGGTTCCCAGAGGAGGAGGAAGGCGGCTGCGAA
CTGCGCGTGAAATTCAGCCGCAGCGCAGATGCT
CCAGCCTACCAGCAGGGGCAGAACCAGCTCTAC
AACGAACTCAATCTTGGTCGGAGAGAGGAGTAC
GACGTGCTGGACAAGCGGAGAGGACGGGACCCA
GAAATGGGCGGGAAGCCGCGCAGAAAGAATCCC
CAAGAGGGCCTGTACAACGAGCTCCAAAAGGAT
AAGATGGCAGAAGCCTATAGCGAGATTGGTATG
AAAGGGGAACGCAGAAGAGGCAAAGGCCACGA
CGGACTGTACCAGGGACTCAGCACCGCCACCAA
GGACACCTATGACGCTCTTCACATGCAGGCCCTG
CCGCCTCGG |

CD20-C2H3

| SEQ ID NO: 55 (Kabat) | HCDR1 | NYWMH |
| SEQ ID NO: 56 (Kabat) | HCDR2 | FITPTTGYPEYNQKFKD |
| SEQ ID NO: 57 (Kabat) | HCDR3 | RKVGKGVYYALDY |
| SEQ ID NO: 58 (Chothia) | HCDR1 | GYTFTNY |
| SEQ ID NO: 59 (Chothia) | HCDR2 | TPTTGY |
| SEQ ID NO: 60 (Chothia) | HCDR3 | RKVGKGVYYALDY |
| SEQ ID NO: 61 (IMGT) | HCDR1 | GYTFTNYW |
| SEQ ID NO: 62 (IMGT) | HCDR2 | ITPTTGYP |
| SEQ ID NO: 63 (IMGT) | HCDR3 | ARRKVGKGVYYALDY |
| SEQ ID NO: 908 (Combined Chothia and Kabat) | HCDR1 | GYTFTNYWMH |

TABLE 1-continued

CD20 CAR Constructs

| SEQ ID NUMBER | Ab region | Sequence |
|---|---|---|
| SEQ ID NO: 909 (Combined Chothia and Kabat) | HCDR2 | FITPTTGYPEYNQKFKD |
| SEQ ID NO: 910 (Combined Chothia and Kabat) | HCDR3 | RKVGKGVYYALDY |
| SEQ ID NO: 64 | VH | QVQLVQSGAEVKKPGASVKVSCKASGYTFTNYW MHWVRQAPGQGLEWMGFITPTTGYPEYNQKFKD RVTMTADKSTSTAYMELSSLRSEDTAVYYCARRK VGKGVYYALDYWGQGTTVTVSS |
| SEQ ID NO: 65 | DNA VH | CAAGTCCAACTCGTCCAGTCCGGTGCAGAAGTC AAGAAACCCGGAGCTTCCGTGAAAGTGTCCTGC AAAGCCTCCGGTTACACCTTTACGAACTACTGGA TGCATTGGGTGCGCCAGGCCCCGGGACAGGGGC TGGAATGGATGGGCTTCATTACCCCCACCACCGG ATACCCCGAGTACAATCAGAAGTTCAAGGACCG GGTCACCATGACCGCCGACAAGTCAACCTCTACT GCTTACATGGAGCTGTCCAGCCTGCGGTCGGAA GATACCGCCGTGTATTACTGCGCGAGAAGGAAA GTCGGAAAGGGAGTGTACTATGCCCTGGACTAC TGGGGACAGGGGACCACTGTGACTGTGTCAAGC |
| SEQ ID NO: 66 (Kabat) | LCDR1 | RASGNIHNYLA |
| SEQ ID NO: 67 (Kabat) | LCDR2 | NTKTLAD |
| SEQ ID NO: 68 (Kabat) | LCDR3 | QHFWSSPWT |
| SEQ ID NO: 69 (Chothia) | LCDR1 | SGNIHNY |
| SEQ ID NO: 70 (Chothia) | LCDR2 | NTK |
| SEQ ID NO: 71 (Chothia) | LCDR3 | FWSSPW |
| SEQ ID NO: 72 (IMGT) | LCDR1 | GNIHNY |
| SEQ ID NO: 73 (IMGT) | LCDR2 | NTK |
| SEQ ID NO: 74 (IMGT) | LCDR3 | QHFWSSPWT |
| SEQ ID NO: 911 (Combined Chothia and Kabat) | LCDR1 | RASGNIHNYLA |
| SEQ ID NO: 912 (Combined Chothia and Kabat) | LCDR2 | NTKTLAD |
| SEQ ID NO: 913 (Combined Chothia and Kabat) | LCDR3 | QHFWSSPWT |
| SEQ ID NO: 75 | VL | AIRMTQSPFSLSASVGDRVTITCRASGNIHNYLAW YQQKPAKAPKLFIYNTKTLADGVPSRFSGSGSGTD YTLTISSLQPEDFATYYCQHFWSSPWTFGGGTKVEIK |

TABLE 1-continued

CD20 CAR Constructs

| SEQ ID NUMBER | Ab region | Sequence |
|---|---|---|
| SEQ ID NO: 76 | DNA VL | GCGATCCGCATGACCCAGAGCCCGTTCTCCCTGT<br>CCGCGTCCGTGGGGGACCGCGTGACTATCACGT<br>GTCGGGCCTCCGGGAACATCCACAACTACCTCGC<br>ATGGTACCAGCAGAAGCCGGCCAAGGCCCCTAA<br>GTTGTTCATCTACAACACCAAGACTCTTGCCGAC<br>GGAGTGCCGTCCCGGTTTAGCGGAAGCGGTTCC<br>GGCACCGACTACACCCTGACTATCTCGAGCCTGC<br>AACCAGAAGATTTCGCCACTTACTACTGCCAGCA<br>CTTCTGGTCGTCCCCTTGGACATTCGGCGGCGGC<br>ACCAAGGTCGAGATTAAG |
| SEQ ID NO: 77 | Linker | GGGGSGGGGSGGGGSGGGGS |
| SEQ ID NO: 78 | scFv (VH-linker-VL) | QVQLVQSGAEVKKPGASVKVSCKASGYTFTNYW<br>MHWVRQAPGQGLEWMGFITPTTGYPEYNQKFKD<br>RVTMTADKSTSTAYMELSSLRSEDTAVYYCARRK<br>VGKGVYYALDYWGQGTTVTVSSGGGGSGGGGSG<br>GGGSGGGGSAIRMTQSPFSLSASVGDRVTITCRASG<br>NIHNYLAWYQQKPAKAPKLFIYNTKTLADGVPSRF<br>SGSGSGTDYTLTISSLQPEDFATYYCQHFWSSPWTF<br>GGGTKVEIK |
| SEQ ID NO: 79 | DNA scFv (VH-linker-VL) | CAAGTCCAACTCGTCCAGTCCGGTGCAGAAGTCAAG<br>AAACCCGGAGCTTCCGTGAAAGTGTCCTGCAAAGCCT<br>CCGGTTACACCTTTACGAACTACTGGATGCATTGGGT<br>GCGCCAGGCCCCGGGACAGGGGCTGGAATGGATGGG<br>CTTCATTACCCCCACCACCGGATACCCCGAGTACAAT<br>CAGAAGTTCAAGGACCGGGTCACCATGACCGCCGAC<br>AAGTCAACCTCTACTGCTTACATGGAGCTGTCCAGCC<br>TGCGGTCGGAAGATACCGCCGTGTATTACTGCGCGAG<br>AAGGAAAGTCGGAAAGGGAGTGTACTATGCCCTGGA<br>CTACTGGGGACAGGGGACCACTGTGACTGTGTCAAG<br>CGGAGGCGGAGGCTCGGGGGGCGGAGGTTCGGGCGG<br>AGGAGGATCAGGGGGCGGCGGTTCCGCGATCCGCAT<br>GACCCAGAGCCCGTTCTCCCTGTCCGCGTCCGTGGGG<br>GACCGCGTGACTATCACGTGTCGGGCCTCCGGGAAC<br>ATCCACAACTACCTCGCATGGTACCAGCAGAAGCCG<br>GCCAAGGCCCCTAAGTTGTTCATCTACAACACCAAGA<br>CTCTTGCCGACGGAGTGCCGTCCCGGTTTAGCGGAAG<br>CGGTTCCGGCACCGACTACACCCTGACTATCTCGAGC<br>CTGCAACCAGAAGATTTCGCCACTTACTACTGCCAGC<br>ACTTCTGGTCGTCCCCTTGGACATTCGGCGGCGGCAC<br>CAAGGTCGAGATTAAG |
| SEQ ID NO: 80 | Full CAR amino acid sequence | MALPVTALLLPLALLLHAARPQVQLVQSGAEVKK<br>PGASVKVSCKASGYTFTNYWMHWVRQAPGQGLE<br>WMGFITPTTGYPEYNQKFKDRVTMTADKSTSTAY<br>MELSSLRSEDTAVYYCARRKVGKGVYYALDYWG<br>QGTTVTVSSGGGGSGGGGSGGGGSGGGGSAIRMT<br>QSPFSLSASVGDRVTITCRASGNIHNYLAWYQQKP<br>AKAPKLFIYNTKTLADGVPSRFSGSGSGTDYTLTIS<br>SLQPEDFATYYCQHFWSSPWTFGGGTKVEIKTTTP<br>APRPPTPAPTIASQPLSLRPEACRPAAGGAVHTRGL<br>DFACDIYIWAPLAGTCGVLLLSLVITLYCKRGRKK<br>LLYIFKQPFMRPVQTTQEEDGCSCRFPEEEEGGCEL<br>RVKFSRSADAPAYQQGQNQLYNELNLGRREEYDV<br>LDKRRGRDPEMGGKPRRKNPQEGLYNELQKDKM<br>AEAYSEIGMKGERRRGKGHDGLYQGLSTATKDTY<br>DALHMQALPPR |
| SEQ ID NO: 81 | Full CAR nucleic acid sequence | ATGGCCCTCCCTGTCACCGCCCTGCTGCTTCCGC<br>TGGCTCTTCTGCTCCACGCCGCTCGGCCCCAAGT<br>CCAACTCGTCCAGTCCGGTGCAGAAGTCAAGAA<br>ACCCGGAGCTTCCGTGAAAGTGTCCTGCAAAGC<br>CTCCGGTTACACCTTTACGAACTACTGGATGCAT<br>TGGGTGCGCCAGGCCCCGGGACAGGGGCTGGAA<br>TGGATGGGCTTCATTACCCCCACCACCGGATACC<br>CCGAGTACAATCAGAAGTTCAAGGACCGGGTCA<br>CCATGACCGCCGACAAGTCAACCTCTACTGCTTA<br>CATGGAGCTGTCCAGCCTGCGGTCGGAAGATAC<br>CGCCGTGTATTACTGCGCGAGAAGGAAAGTCGG<br>AAAGGGAGTGTACTATGCCCTGGACTACTGGGG<br>ACAGGGGACCACTGTGACTGTGTCAAGCGGAGG<br>CGGAGGCTCGGGGGGCGGAGGTTCGGGCGGAGG |

TABLE 1-continued

CD20 CAR Constructs

| SEQ ID NUMBER | Ab region | Sequence |
|---|---|---|
| | | AGGATCAGGGGCGGCGGTTCCGCGATCCGCAT |
| | | GACCCAGAGCCCGTTCTCCCTGTCCGCGTCCGTG |
| | | GGGGACCGCGTGACTATCACGTGTCGGGCCTCC |
| | | GGGAACATCCACAACTACCTCGCATGGTACCAG |
| | | CAGAAGCCGGCCAAGGCCCCTAAGTTGTTCATCT |
| | | ACAACACCAAGACTCTTGCCGACGGAGTGCCGT |
| | | CCCGGTTTAGCGGAAGCGGTTCCGGCACCGACT |
| | | ACACCCTGACTATCTCGAGCCTGCAACCAGAAG |
| | | ATTTCGCCACTTACTACTGCCAGCACTTCTGGTC |
| | | GTCCCCTTGGACATTCGGCGGCGGCACCAAGGTC |
| | | GAGATTAAGACCACTACCCCAGCACCGAGGCCA |
| | | CCCACCCCGGCTCCTACCATCGCCTCCCAGCCTC |
| | | TGTCCCTGCGTCCGGAGGCATGTAGACCCGCAGC |
| | | TGGTGGGGCCGTGCATACCCGGGGTCTTGACTTC |
| | | GCCTGCGATATCTACATTTGGGCCCCTCTGGCTG |
| | | GTACTTGCGGGGTCCTGCTGCTTTCACTCGTGAT |
| | | CACTCTTTACTGTAAGCGCGGTCGGAAGAAGCTG |
| | | CTGTACATCTTTAAGCAACCCTTCATGAGGCCTG |
| | | TGCAGACTACTCAAGAGGAGGACGGCTGTTCAT |
| | | GCCGGTTCCCAGAGGAGGAAGGCGGCTGCG |
| | | AACTGCGCGTGAAATTCAGCCGCAGCGCAGATG |
| | | CTCCAGCCTACCAGCAGGGGCAGAACCAGCTCT |
| | | ACAACGAACTCAATCTTGGTCGGAGAGAGGAGT |
| | | ACGACGTGCTGGACAAGCGGAGAGGACGGGACC |
| | | CAGAAATGGGCGGAAGCCGCGCAGAAAGAATC |
| | | CCCAAGAGGGCCTGTACAACGAGCTCCAAAAGG |
| | | ATAAGATGGCAGAAGCCTATAGCGAGATTGGTA |
| | | TGAAAGGGGAACGCAGAAGAGGCAAAGGCCAC |
| | | GACGGACTGTACCAGGGACTCAGCACCGCCACC |
| | | AAGGACACCTATGACGCTCTTCACATGCAGGCCC |
| | | TGCCGCCTCGG |

CD20-C2H4

| SEQ ID NO: 82 (Kabat) | HCDR1 | NYWMH |
| SEQ ID NO: 83 (Kabat) | HCDR2 | FITPTTGYPEYNQKFKD |
| SEQ ID NO: 84 (Kabat) | HCDR3 | RKVGKGVYYALDY |
| SEQ ID NO: 85 (Chothia) | HCDR1 | GYTFTNY |
| SEQ ID NO: 86 (Chothia) | HCDR2 | TPTTGY |
| SEQ ID NO: 87 (Chothia) | HCDR3 | RKVGKGVYYALDY |
| SEQ ID NO: 88 (IMGT) | HCDR1 | GYTFTNYW |
| SEQ ID NO: 89 (IMGT) | HCDR2 | ITPTTGYP |
| SEQ ID NO: 90 (IMGT) | HCDR3 | ARRKVGKGVYYALDY |
| SEQ ID NO: 914 (Combined Chothia and Kabat) | HCDR1 | GYTFTNYWMH |
| SEQ ID NO: 915 (Combined Chothia and Kabat) | HCDR2 | FITPTTGYPEYNQKFKD |
| SEQ ID NO: 916 (Combined Chothia and Kabat) | HCDR3 | RKVGKGVYYALDY |

TABLE 1-continued

CD20 CAR Constructs

| SEQ ID NUMBER | Ab region | Sequence |
|---|---|---|
| SEQ ID NO: 91 | VH | QVQLVQSGAEVKKPGSSVKVSCKASGYTFTNYW MHWVRQAPGQGLEWMGFITPTTGYPEYNQKFKD RVTITADKSTSTAYMELSSLRSEDTAVYYCARRKV GKGVYYALDYWGQGTTVTVSS |
| SEQ ID NO: 92 | DNA VH | CAAGTCCAACTCGTCCAAAGCGGTGCAGAAGTC AAGAAGCCCGGTTCCTCCGTGAAAGTGTCCTGCA AAGCCTCGGGCTACACCTTCACTAATTACTGGAT GCATTGGGTCCGCCAGGCGCCCGGACAGGGATT GGAATGGATGGGGTTCATCACGCCGACCACCGG ATACCCGGAGTACAACCAGAAGTTCAAGGACAG AGTGACCATTACCGCCGATAAGTCCACCTCCACC GCTTACATGGAGCTCTCCTCACTGCGGTCCGAAG ATACAGCCGTGTACTATTGTGCTCGCCGGAAAGT CGGAAAGGGAGTGTACTACGCCCTGGACTATTG GGGCCAGGGCACCACCGTGACCGTGTCCTCG |
| SEQ ID NO: 93 (Kabat) | LCDR1 | RASGNIHNYLA |
| SEQ ID NO: 94 (Kabat) | LCDR2 | NTKTLAD |
| SEQ ID NO: 95 (Kabat) | LCDR3 | QHFWSSPWT |
| SEQ ID NO: 96 (Chothia) | LCDR1 | SGNIHNY |
| SEQ ID NO: 97 (Chothia) | LCDR2 | NTK |
| SEQ ID NO: 98 (Chothia) | LCDR3 | FWSSPW |
| SEQ ID NO: 99 (IMGT) | LCDR1 | GNIHNY |
| SEQ ID NO: 100 (IMGT) | LCDR2 | NTK |
| SEQ ID NO: 101 (IMGT) | LCDR3 | QHFWSSPWT |
| SEQ ID NO: 917 (Combined Chothia and Kabat) | LCDR1 | RASGNIHNYLA |
| SEQ ID NO: 918 (Combined Chothia and Kabat) | LCDR2 | NTKTLAD |
| SEQ ID NO: 919 (Combined Chothia and Kabat) | LCDR3 | QHFWSSPWT |
| SEQ ID NO: 102 | VL | AIRMTQSPFSLSASVGDRVTITCRASGNIHNYLAW YQQKPAKAPKLFIYNTKTLADGVPSRFSGSGSGTD YTLTISSLQPEDFATYYCQHFWSSPWTFGGGTKVEIK |
| SEQ ID NO: 103 | DNA VL | GCCATTAGGATGACTCAGTCCCCTTTCTCCCTCT CCGCGAGCGTGGGCGACCGCGTGACGATCACTT GCCGGGCCTCGGGGAACATTCACAACTACCTGG CCTGGTACCAGCAGAAGCCGGCCAAGGCCCCTA AGCTGTTCATCTACAACACCAAGACCCTTGCGGA CGGAGTGCCATCGAGATTTTCCGGCTCGGGCTCT GGGACCGATTACACTCTGACTATCTCAAGCCTGC AACCTGAGGACTTCGCCACTTACTACTGCCAGCA CTTCTGGAGCAGCCCCTGGACTTTCGGTGGCGGG ACCAAGGTCGAAATCAAG |

TABLE 1-continued

| CD20 CAR Constructs | | |
|---|---|---|
| SEQ ID NUMBER | Ab region | Sequence |
| SEQ ID NO: 104 | Linker | GGGGSGGGGSGGGGSGGGGS |
| SEQ ID NO: 105 | scFv (VH-linker-VL) | QVQLVQSGAEVKKPGSSVKVSCKASGYTFTNYW MHWVRQAPGQGLEWMGFITPTTGYPEYNQKFKD RVTITADKSTSTAYMELSSLRSEDTAVYYCARRKV GKGVYYALDYWGQGTTVTVSSGGGGSGGGGSGG GGSGGGGSAIRMTQSPFSLSASVGDRVTITCRASGN IHNYLAWYQQKPAKAPKLFIYNTKTLADGVPSRFS GSGSGTDYTLTISSLQPEDFATYYCQHFWSSPWTF GGGTKVEIK |
| SEQ ID NO: 106 | DNA scFv (VH-linker-VL) | CAAGTCCAACTCGTCCAAAGCGGTGCAGAAGTCAAG AAGCCCGGTTCCTCCGTGAAAGTGTCCTGCAAAGCCT CGGGCTACACCTTCACTAATTACTGGATGCATTGGGT CCGCCAGGCGCCCGGACAGGGATTGGAATGGATGGG GTTCATCACGCCGACCACCGGATACCCGGAGTACAA CCAGAAGTTCAAGGACAGAGTGACCATTACCGCCGA TAAGTCCACCTCCACCGCTTACATGGAGCTCTCCTCA CTGCGGTCCGAAGATACAGCCGTGTACTATTGTGCTC GCCGGAAAGTCGGAAAGGGAGTGTACTACGCCCTGG ACTATTGGGGCCAGGGCACCACCGTGACCGTGTCCTC GGGAGGAGGGGGTTCGGGCGGAGGCGGCTCCGGTGG AGGCGGAAGCGGAGGGGGCGGATCAGCCATTAGGAT GACTCAGTCCCCTTTCTCCCTCTCCGCGAGCGTGGGC GACCGCGTGACGATCACTTGCCGGGCCTCGGGGAAC ATTCACAACTACCTGGCCTGGTACCAGCAGAAGCCG GCCAAGGCCCCTAAGCTGTTCATCTACAACACCAAGA CCCTTGCGGACGGAGTGCCATCGAGATTTTCCGGCTC GGGCTCTGGGACCGATTACACTCTGACTATCTCAAGC CTGCAACCTGAGGACTTCGCCACTTACTACTGCCAGC ACTTCTGGAGCAGCCCCTGGACTTTCGGTGGCGGGAC CAAGGTCGAAATCAAG |
| SEQ ID NO: 107 | Full CAR amino acid sequence | MALPVTALLLPLALLLHAARPQVQLVQSGAEVKK PGSSVKVSCKASGYTFTNYWMHWVRQAPGQGLE WMGFITPTTGYPEYNQKFKDRVTITADKSTSTAYM ELSSLRSEDTAVYYCARRKVGKGVYYALDYWGQ GTTVTVSSGGGGSGGGGSGGGGSGGGGSAIRMTQ SPFSLSASVGDRVTITCRASGNIHNYLAWYQQKPA KAPKLFIYNTKTLADGVPSRFSGSGSGTDYTLTISSL QPEDFATYYCQHFWSSPWTFGGGTKVEIKTTTPAP RPPTPAPTIASQPLSLRPEACRPAAGGAVHTRGLDF ACDIYIWAPLAGTCGVLLLSLVITLYCKRGRKKLL YIFKQPFMRPVQTTQEEDGCSCRFPEEEEGGCELRV KFSRSADAPAYQQGQNQLYNELNLGRREEYDVLD KRRGRDPEMGGKPRRKNPQEGLYNELQKDKMAE AYSEIGMKGERRRGKGHDGLYQGLSTATKDTYDA LHMQALPPR |
| SEQ ID NO: 108 | Full CAR nucleic acid sequence | ATGGCCCTCCCTGTCACCGCCCTGCTGCTTCCGC TGGCTCTTCTGCTCCACGCCGCTCGGCCCCAAGT CCAACTCGTCCAAAGCGGTGCAGAAGTCAAGAA GCCCGGTTCCTCCGTGAAAGTGTCCTGCAAAGCC TCGGGCTACACCTTCACTAATTACTGGATGCATT GGGTCCGCCAGGCGCCCGGACAGGGATTGGAAT GGATGGGGTTCATCACGCCGACCACCGGATACC CGGAGTACAACCAGAAGTTCAAGGACAGAGTGA CCATTACCGCCGATAAGTCCACCTCCACCGCTTA CATGGAGCTCTCCTCACTGCGGTCCGAAGATACA GCCGTGTACTATTGTGCTCGCCGGAAAGTCGGAA AGGGAGTGTACTACGCCCTGGACTATTGGGGCC AGGGCACCACCGTGACCGTGTCCTCGGGAGGAG GGGGTTCGGGCGGAGGCGGCTCCGGTGGAGGCG GAAGCGGAGGGGGCGGATCAGCCATTAGGATGA CTCAGTCCCCTTTCTCCCTCTCCGCGAGCGTGGG CGACCGCGTGACGATCACTTGCCGGGCCTCGGG GAACATTCACAACTACCTGGCCTGGTACCAGCA GAAGCCGGCCAAGGCCCCTAAGCTGTTCATCTAC AACACCAAGACCCTTGCGGACGGAGTGCCATCG AGATTTTCCGGCTCGGGCTCTGGGACCGATTACA CTCTGACTATCTCAAGCCTGCAACCTGAGGACTT CGCCACTTACTACTGCCAGCACTTCTGGAGCAGC CCCTGGACTTTCGGTGGCGGGACCAAGGTCGAA ATCAAGACCACTACCCCAGCACCGAGGCCACCC ACCCCGGCTCCTACCATCGCCTCCCAGCCTCTGT CCCTGCGTCCGGAGGCATGTAGACCCGCAGCTG |

TABLE 1-continued

CD20 CAR Constructs

| SEQ ID NUMBER | Ab region | Sequence |
|---|---|---|
| | | GTGGGGCCGTGCATACCCGGGGTCTTGACTTCGC<br>CTGCGATATCTACATTTGGGCCCCTCTGGCTGGT<br>ACTTGCGGGGTCCTGCTGCTTTCACTCGTGATCA<br>CTCTTTACTGTAAGCGCGGTCGGAAGAAGCTGCT<br>GTACATCTTTAAGCAACCCTTCATGAGGCCTGTG<br>CAGACTACTCAAGAGGAGGACGGCTGTTCATGC<br>CGGTTCCCAGAGGAGGAGGAAGGCGGCTGCGAA<br>CTGCGCGTGAAATTCAGCCGCAGCGCAGATGCT<br>CCAGCCTACCAGCAGGGGCAGAACCAGCTCTAC<br>AACGAACTCAATCTTGGTCGGAGAGAGGAGTAC<br>GACGTGCTGGACAAGCGGAGAGGACGGGACCCA<br>GAAATGGGCGGGAAGCCGCGCAGAAAGAATCCC<br>CAAGAGGGCCTGTACAACGAGCTCCAAAAGGAT<br>AAGATGGCAGAAGCCTATAGCGAGATTGGTATG<br>AAAGGGGAACGCAGAAGAGGCAAAGGCCACGA<br>CGGACTGTACCAGGGACTCAGCACCGCCACCAA<br>GGACACCTATGACGCTCTTCACATGCAGGCCCTG<br>CCGCCTCGG |

CD20-C3H1

| SEQ ID NO: 109 (Kabat) | HCDR1 | NYNLH |
|---|---|---|
| SEQ ID NO: 110 (Kabat) | HCDR2 | AIYPGNYDTSYNQKFKG |
| SEQ ID NO: 111 (Kabat) | HCDR3 | VDFGHSRYWYFDV |
| SEQ ID NO: 112 (Chothia) | HCDR1 | GYTFTNY |
| SEQ ID NO: 113 (Chothia) | HCDR2 | YPGNYD |
| SEQ ID NO: 114 (Chothia) | HCDR3 | VDFGHSRYWYFDV |
| SEQ ID NO: 115 (IMGT) | HCDR1 | GYTFTNYN |
| SEQ ID NO: 116 (IMGT) | HCDR2 | IYPGNYDT |
| SEQ ID NO: 117 (IMGT) | HCDR3 | ARVDFGHSRYWYFDV |
| SEQ ID NO: 920 (Combined Chothia and Kabat) | HCDR1 | GYTFTNYNLH |
| SEQ ID NO: 921 (Combined Chothia and Kabat) | HCDR2 | AIYPGNYDTSYNQKFKG |
| SEQ ID NO: 922 (Combined Chothia and Kabat) | HCDR3 | VDFGHSRYWYFDV |
| SEQ ID NO: 118 | VH | QVQLVQSGAEVKKPGASVKVSCKASGYTFTNYNL<br>HWVRQAPGQGLEWMGAIYPGNYDTSYNQKFKGR<br>VTMTADKSTSTAYMELSSLRSEDTAVYYCARVDF<br>GHSRYWYFDVWGQGTTVTVSS |
| SEQ ID NO: 119 | DNA VH | CAAGTCCAACTCGTCCAATCCGGTGCAGAAGTC<br>AAGAAACCCGGTGCATCCGTCAAAGTGTCATGC<br>AAAGCCTCCGGGTACACCTTCACTAACTACAACC<br>TCCACTGGGTCCGCCAGGCCCCGGGACAGGGAC<br>TGGAGTGGATGGGGGCCATCTACCCGGGAAACT<br>ACGACACTTCATACAACCAGAAGTTCAAGGGCA<br>GAGTGACCATGACTGCCGACAAGAGCACATCGA |

TABLE 1-continued

CD20 CAR Constructs

| SEQ ID NUMBER | Ab region | Sequence |
|---|---|---|
| | | CCGCCTACATGGAACTCAGCTCCCTGCGCTCCGA GGATACTGCCGTCTACTACTGTGCCCGGGTGGAC TTCGGCCACTCCCGGTATTGGTATTTCGATGTCT GGGGACAGGGAACCACCGTGACTGTGTCCAGC |
| SEQ ID NO: 120 (Kabat) | LCDR1 | RATSSVSSMN |
| SEQ ID NO: 121 (Kabat) | LCDR2 | ATSNLAS |
| SEQ ID NO: 122 (Kabat) | LCDR3 | QQWTFNPPT |
| SEQ ID NO: 123 (Chothia) | LCDR1 | TSSVSS |
| SEQ ID NO: 124 (Chothia) | LCDR2 | ATS |
| SEQ ID NO: 125 (Chothia) | LCDR3 | WTFNPP |
| SEQ ID NO: 126 (IMGT) | LCDR1 | SSVSS |
| SEQ ID NO: 127 (IMGT) | LCDR2 | ATS |
| SEQ ID NO: 128 (IMGT) | LCDR3 | QQWTFNPPT |
| SEQ ID NO: 923 (Combined Chothia and Kabat) | LCDR1 | RATSSVSSMN |
| SEQ ID NO: 924 (Combined Chothia and Kabat) | LCDR2 | ATSNLAS |
| SEQ ID NO: 925 (Combined Chothia and Kabat) | LCDR3 | QQWTFNPPT |
| SEQ ID NO: 129 | VL | EIVLTQSPATLSLSPGERATLSCRATSSVSSMNWYQ QKPGQAPRPLIHATSNLASGIPARFSGSGSGTDYTL TISSLEPEDAAVYYCQQWTFNPPTFGQGTKLEIK |
| SEQ ID NO: 130 | DNA VL | GAAATCGTGCTGACCCAGTCCCCTGCGACTCTGA GCCTGAGCCCTGGGGAACGCGCCACTTTGTCATG CCGGGCCACCTCCTCCGTGTCCTCCATGAACTGG TACCAGCAGAAGCCCGGACAGGCTCCGCGGCCG CTGATCCATGCCACCTCCAACCTGGCCAGCGGCA TTCCCGCGAGGTTTTCCGGCTCGGGCTCTGGTAC CGACTACACCCTGACCATCTCGAGCCTTGAGCCA GAAGATGCTGCGGTGTACTACTGCCAACAGTGG ACCTTCAATCCGCCTACGTTCGGACAGGGGACCA AGCTGGAGATTAAG |
| SEQ ID NO: 131 | Linker | GGGGSGGGGSGGGGSGGGGS |
| SEQ ID NO: 132 | scFv (VH-linker-VL) | QVQLVQSGAEVKKPGASVKVSCKASGYTFTNYNL HWVRQAPGQGLEWMGAIYPGNYDTSYNQKFKGR VTMTADKSTSTAYMELSSLRSEDTAVYYCARVDF GHSRYWYFDVWGQGTTVTVSSGGGGSGGGGSGG GGSGGGGSEIVLTQSPATLSLSPGERATLSCRATSS VSSMNWYQQKPGQAPRPLIHATSNLASGIPARFSG SGSGTDYTLTISSLEPEDAAVYYCQQWTFNPPTFG QGTKLEIK |

TABLE 1-continued

CD20 CAR Constructs

| SEQ ID NUMBER | Ab region | Sequence |
|---|---|---|
| SEQ ID NO: 133 | DNA scFv (VH-linker-VL) | CAAGTCCAACTCGTCCAATCCGGTGCAGAAGTCAAG<br>AAACCCGGTGCATCCGTGAAAGTGTCATGCAAAGCC<br>TCCGGGTACACCTTCACTAACTACAACCTCCACTGGG<br>TCCGCCAGGCCCCGGGACAGGGACTGGAGTGGATGG<br>GGGCCATCTACCCGGGAAACTACGACACTTCATACA<br>ACCAGAAGTTCAAGGGCAGAGTGACCATGACTGCCG<br>ACAAGAGCACATCGACCGCCTACATGGAACTCAGCT<br>CCCTGCGCTCCGAGGATACTGCCGTCTACTACTGTGC<br>CCGGGTGGACTTCGGCCACTCCCGGTATTGGTATTTC<br>GATGTCTGGGGACAGGGAACCACCGTGACTGTGTCC<br>AGCGGGGGCGGAGGATCGGGTGGCGGAGGTTCGGGG<br>GGAGGAGGATCAGGCGGCGGCGGATCGGAAATCGTG<br>CTGACCCAGTCCCCTGCGACTCTGAGCCTGAGCCCTG<br>GGGAACGCGCCACTTTGTCATGCCGGGCCACCTCCTC<br>CGTGTCCTCCATGAACTGGTACCAGCAGAAGCCCGG<br>ACAGGCTCCGCGGCCGCTGATCCATGCCACCTCCAAC<br>CTGGCCAGCGGCATTCCCGCGAGGTTTTCCGGCTCGG<br>GCTCTGGTACCGACTACACCCTGACCATCTCGAGCCT<br>TGAGCCAGAAGATGCTGCGGTGTACTACTGCCAACA<br>GTGGACCTTCAATCCGCCTACGTTCGGACAGGGGACC<br>AAGCTGGAGATTAAG |
| SEQ ID NO: 134 | Full CAR amino acid sequence | MALPVTALLLPLALLLHAARPQVQLVQSGAEVKK<br>PGASVKVSCKASGYTFTNYNLHWVRQAPGQGLE<br>WMGAIYPGNYDTSYNQKFKGRVTMTADKSTSTA<br>YMELSSLRSEDTAVYYCARVDFGHSRYWYFDVW<br>GQGTTVTVSSGGGGSGGGGSGGGGSGGGGSEIVLT<br>QSPATLSLSPGERATLSCRATSSVSSMNWYQQKPG<br>QAPRPLIHATSNLASGIPARFSGSGSGTDYTLTISSL<br>EPEDAAVYYCQQWTFNPPTFGQGTKLEIKTTTPAP<br>RPPTPAPTIASQPLSLRPEACRPAAGGAVHTRGLDF<br>ACDIYIWAPLAGTCGVLLLSLVITLYCKRGRKKLL<br>YIFKQPFMRPVQTTQEEDGCSCRFPEEEEGGCELRV<br>KFSRSADAPAYQQGQNQLYNELNLGRREEYDVLD<br>KRRGRDPEMGGKPRRKNPQEGLYNELQKDKMAE<br>AYSEIGMKGERRRGKGHDGLYQGLSTATKDTYDA<br>LHMQALPPR |
| SEQ ID NO: 135 | Full CAR nucleic acid sequence | ATGGCCCTCCCTGTCACCGCCCTGCTGCTTCCGC<br>TGGCTCTTCTGCTCCACGCCGCTCGGCCCCAAGT<br>CCAACTCGTCCAATCCGGTGCAGAAGTCAAGAA<br>ACCCGGTGCATCCGTGAAAGTGTCATGCAAAGC<br>CTCCGGGTACACCTTCACTAACTACAACCTCCAC<br>TGGGTCCGCCAGGCCCCGGGACAGGGACTGGAG<br>TGGATGGGGGCCATCTACCCGGGAAACTACGAC<br>ACTTCATACAACCAGAAGTTCAAGGGCAGAGTG<br>ACCATGACTGCCGACAAGAGCACATCGACCGCC<br>TACATGGAACTCAGCTCCCTGCGCTCCGAGGATA<br>CTGCCGTCTACTACTGTGCCCGGGTGGACTTCGG<br>CCACTCCCGGTATTGGTATTTCGATGTCTGGGGA<br>CAGGGAACCACCGTGACTGTGTCCAGCGGGGGC<br>GGAGGATCGGGTGGCGGAGGTTCGGGGGGAGGA<br>GGATCAGGCGGCGGCGGATCGGAAATCGTGCTG<br>ACCCAGTCCCCTGCGACTCTGAGCCTGAGCCCTG<br>GGGAACGCGCCACTTTGTCATGCCGGGCCACCTC<br>CTCCGTGTCCTCCATGAACTGGTACCAGCAGAAG<br>CCCGGACAGGCTCCGCGGCCGCTGATCCATGCC<br>ACCTCCAACCTGGCCAGCGGCATTCCCGCGAGGT<br>TTTCCGGCTCGGGCTCTGGTACCGACTACACCCT<br>GACCATCTCGAGCCTTGAGCCAGAAGATGCTGC<br>GGTGTACTACTGCCAACAGTGGACCTTCAATCCG<br>CCTACGTTCGGACAGGGGACCAAGCTGGAGATT<br>AAGACCACTACCCCAGCACCGAGGCCACCCACC<br>CCGGCTCCTACCATCGCCTCCCAGCCTCTGTCCC<br>TGCGTCCGGAGGCATGTAGACCCGCAGCTGGTG<br>GGGCCGTGCATACCCGGGGTCTTGACTTCGCCTG<br>CGATATCTACATTTGGGCCCCTCTGGCTGGTACT<br>TGCGGGGTCCTGCTGCTTTCACTCGTGATCACTC<br>TTTACTGTAAGCGCGGTCGGAAGAAGCTGCTGTA<br>CATCTTTAAGCAACCCTTCATGAGGCCTGTGCAG<br>ACTACTCAAGAGGAGGACGGCTGTTCATGCCGG<br>TTCCCAGAGGAGGAGGAAGGCGGCTGCGAACTG<br>CGCGTGAAATTCAGCCGCAGCGCAGATGCTCCA<br>GCCTACCAGCAGGGGCAGAACCAGCTCTACAAC |

TABLE 1-continued

CD20 CAR Constructs

| SEQ ID NUMBER | Ab region | Sequence |
|---|---|---|
| | | GAACTCAATCTTGGTCGGAGAGAGGAGTACGAC GTGCTGGACAAGCGGAGAGGACGGGACCCAGAA ATGGGCGGGAAGCCGCGCAGAAAGAATCCCCAA GAGGGCCTGTACAACGAGCTCCAAAAGGATAAG ATGGCAGAAGCCTATAGCGAGATTGGTATGAAA GGGGAACGCAGAAGAGGCAAAGGCCACGACGG ACTGTACCAGGGACTCAGCACCGCCACCAAGGA CACCTATGACGCTCTTCACATGCAGGCCCTGCCG CCTCGG |

CD20-C3H3

| SEQ ID NO: 163 (Kabat) | HCDR1 | NYNLH |
| SEQ ID NO: 164 (Kabat) | HCDR2 | AIYPGNYDTSYNQKFKG |
| SEQ ID NO: 165 (Kabat) | HCDR3 | VDFGHSRYWYFDV |
| SEQ ID NO: 166 (Chothia) | HCDR1 | GYTFTNY |
| SEQ ID NO: 167 (Chothia) | HCDR2 | YPGNYD |
| SEQ ID NO: 168 (Chothia) | HCDR3 | VDFGHSRYWYFDV |
| SEQ ID NO: 169 (IMGT) | HCDR1 | GYTFTNYN |
| SEQ ID NO: 170 (IMGT) | HCDR2 | IYPGNYDT |
| SEQ ID NO: 171 (IMGT) | HCDR3 | ARVDFGHSRYWYFDV |
| SEQ ID NO: 172 | VH | QVQLVQSGAEVKKPGASVKVSCKASGYTFTNYW MHWVRQAPGQGLEWMGFITPTTGYPEYNQKFKD RVTMTADKSTSTAYMELSSLRSEDTAVYYCARRK VGKGVYYALDYWGQGTTVTVSS |
| SEQ ID NO: 173 | DNA VH | CAAGTCCAACTCGTCCAGTCGGGAGCAGAAGTC AAGAAGCCCGGATCATCCGTGAAAGTGTCCTGC AAAGCCTCAGGCTACACCTTTACCAACTACAACT TGCACTGGGTCAGACAGGCCCCGGGACAGGGCC TGGAGTGGATGGGCGCCATCTACCCCGGAAACT ATGACACCTCGTACAACCAGAAGTTCAAGGGTC GCGTGACTATCACGGCTGACAAGTCCACTAGCA CCGCGTACATGGAACTTTCCTCACTGCGGTCCGA GGATACTGCGGTGTACTACTGCGCCCGGGTGGA CTTCGGACACTCGAGATATTGGTACTTCGATGTC TGGGGACAGGGGACCACCGTGACTGTGTCCTCC |
| SEQ ID NO: 174 (Kabat) | LCDR1 | RATSSVSSMN |
| SEQ ID NO: 175 (Kabat) | LCDR2 | ATSNLAS |
| SEQ ID NO: 176 (Kabat) | LCDR3 | QQWTFNPPT |
| SEQ ID NO: 177 (Chothia) | LCDR1 | TSSVSS |
| SEQ ID NO: 178 (Chothia) | LCDR2 | ATS |
| SEQ ID NO: 179 (Chothia) | LCDR3 | WTFNPP |
| SEQ ID NO: 180 (IMGT) | LCDR1 | SSVSS |

TABLE 1-continued

CD20 CAR Constructs

| SEQ ID NUMBER | Ab region | Sequence |
|---|---|---|
| SEQ ID NO: 181 (IMGT) | LCDR2 | ATS |
| SEQ ID NO: 182 (IMGT) | LCDR3 | QQWTFNPPT |
| SEQ ID NO: 932 (Combined Chothia and Kabat) | LCDR1 | RATSSVSSMN |
| SEQ ID NO: 933 (Combined Chothia and Kabat) | LCDR2 | ATSNLAS |
| SEQ ID NO: 934 (Combined Chothia and Kabat) | LCDR3 | QQWTFNPPT |
| SEQ ID NO: 183 | VL | AIRMTQSPFSLSASVGDRVTITCRASGNIHNYLAW YQQKPAKAPKLFIYNTKTLADGVPSRFSGSGSGTD YTLTISSLQPEDFATYYCQHFWSSPWTFGGGTKVEIK |
| SEQ ID NO: 184 | DNA VL | GAAATTGTGCTGACCCAGTCTCCCGCAACCCTGT CCCTGAGCCCTGGAGAGCGCGCCACCCTGTCCTG CCGGGCCACATCCTCCGTGTCGTCCATGAACTGG TACCAGCAGAAGCCCGGCCAAGCCCCGAGGCCT CTGATTCATGCTACCTCAAATCTGGCCAGCGGAA TCCCGGCGCGCTTCTCCGGCTCGGGCAGCGGTAC TGACTACACTCTCACCATCTCGTCCCTCGAACCG GAGGACGCCGCCGTCTACTACTGTCAGCAGTGG ACCTTCAACCCACCTACTTTCGGACAAGGGACCA AGCTGGAGATCAAG |
| SEQ ID NO: 185 | Linker | GGGSGGGGSGGGGSGGGGS |
| SEQ ID NO: 186 | scFv (VH-linker-VL) | QVQLVQSGAEVKKPGASVKVSCKASGYTFTNYW MHWVRQAPGQGLEWMGFITPTTGYPEYNQKFKD RVTMTADKSTSTAYMELSSLRSEDTAVYYCARRK VGKGVYYALDYWGQGTTVTVSSGGGGSGGGGSG GGGSGGGGSAIRMTQSPFSLSASVGDRVTITCRASG NIHNYLAWYQQKPAKAPKLFIYNTKTLADGVPSRF SGSGSGTDYTLTISSLQPEDFATYYCQHFWSSPWTF GGGTKVEIK |
| SEQ ID NO: 187 | DNA scFv (VH-linker-VL) | CAAGTCCAACTCGTCCAGTCGGGAGCAGAAGTCAAG AAGCCCGGATCATCCGTGAAAGTGTCCTGCAAAGCCT CAGGCTACACCTTTACCAACTACAACTTGCACTGGGT CAGACAGGCCCCGGGACAGGGCCTGGAGTGGATGGG CGCCATCTACCCCGGAAACTATGACACCTCGTACAAC CAGAAGTTCAAGGGTCGCGTGACTATCACGGCTGAC AAGTCCACTAGCACCGCGTACATGGAACTTTCCTCAC TGCGGTCCGAGGATACTGCGGTGTACTACTGCGCCCG GGTGGACTTCGGACACTCGAGATATTGGTACTTCGAT GTCTGGGGACAGGGGACCACCGTGACTGTGTCCTCCG GGGGCGGTGGCAGCGGGGGAGGCGGAAGCGGCGGA GGGGGTTCCGGGGGTGGAGGAAGCGAAATTGTGCTG ACCCAGTCTCCCGCAACCCTGTCCCTGAGCCCTGGAG AGCGCGCCACCCTGTCCTGCCGGGCCACATCCTCCGT GTCGTCCATGAACTGGTACCAGCAGAAGCCCGGCCA AGCCCCGAGGCCTCTGATTCATGCTACCTCAAATCTG GCCAGCGGAATCCCGGCGCGCTTCTCCGGCTCGGGCA GCGGTACTGACTACACTCTCACCATCTCGTCCCTCGA ACCGGAGGACGCCGCCGTCTACTACTGTCAGCAGTG GACCTTCAACCCACCTACTTTCGGACAAGGGACCAAG CTGGAGATCAAG |
| SEQ ID NO: 188 | Full CAR amino acid sequence | MALPVTALLLPLALLLHAARPQVQLVQSGAEVKK PGSSVKVSCKASGYTFTNYNLHWVRQAPGQGLEW MGAIYPGNYDTSYNQKFKGRVTITADKSTSTAYM ELSSLRSEDTAVYYCARVDFGHSRYWYFDVWGQG TTVTVSSGGGGSGGGGSGGGGSGGGGSEIVLTQSP |

TABLE 1-continued

CD20 CAR Constructs

| SEQ ID NUMBER | Ab region | Sequence |
|---|---|---|
| | | ATLSLSPGERATLSCRATSSVSSMNWYQQKPGQAP<br>RPLIHATSNLASGIPARFSGSGSGTDYTLTISSLEPED<br>AAVYYCQQWTFNPPTFGQGTKLEIKTTTPAPRPPTP<br>APTIASQPLSLRPEACRPAAGGAVHTRGLDFACDIY<br>IWAPLAGTCGVLLLSLVITLYCKRGRKKLLYIFKQP<br>FMRPVQTTQEEDGCSCRFPEEEEGGCELRVKFSRS<br>ADAPAYQQGQNQLYNELNLGRREEYDVLDKRRG<br>RDPEMGGKPRRKNPQEGLYNELQKDKMAEAYSEI<br>GMKGERRRGKGHDGLYQGLSTATKDTYDALHMQ<br>ALPPR |
| SEQ ID NO: 189 | Full CAR nucleic acid sequence | ATGGCCCTCCCTGTCACCGCCCTGCTGCTTCCGC<br>TGGCTCTTCTGCTCCACGCCGCTCGGCCCCAAGT<br>CCAACTCGTCCAGTCGGGAGCAGAAGTCAAGAA<br>GCCCGGATCATCCGTGAAAGTGTCCTGCAAAGC<br>CTCAGGCTACACCTTTACCAACTACAACTTGCAC<br>TGGGTCAGACAGGCCCCGGGACAGGGCCTGGAG<br>TGGATGGGCGCCATCTACCCCGGAAACTATGAC<br>ACCTCGTACAACCAGAAGTTCAAGGGTCGCGTG<br>ACTATCACGGCTGACAAGTCCACTAGCACCGCGT<br>ACATGGAACTTTCCTCACTGCGGTCCGAGGATAC<br>TGCGGTGTACTACTGCGCCCGGGTGGACTTCGGA<br>CACTCGAGATATTGGTACTTCGATGTCTGGGGAC<br>AGGGGACCACCGTGACTGTGTCCTCCGGGGGCG<br>GTGGCAGCGGGGGAGGCGGAAGCGGCGGAGGG<br>GGTTCCGGGGGTGGAGGAAGCGAAATTGTGCTG<br>ACCCAGTCTCCCGCAACCCTGTCCCTGAGCCCTG<br>GAGAGCGCGCCACCCTGTCCTGCCGGGCCACAT<br>CCTCCGTGTCGTCCATGAACTGGTACCAGCAGAA<br>GCCCGGCCAAGCCCCGAGGCCTCTGATTCATGCT<br>ACCTCAAATCTGGCCAGCGGAATCCCGGCGCGC<br>TTCTCCGGCTCGGGCAGCGGTACTGACTACACTC<br>TCACCATCTCGTCCCTCGAACCGGAGGACGCCGC<br>CGTCTACTACTGTCAGCAGTGGACCTTCAACCCA<br>CCTACTTTCGGACAAGGGACCAAGCTGGAGATC<br>AAGACCACTACCCCAGCACCGAGGCCACCCACC<br>CCGGCTCCTACCATCGCCTCCCAGCCTCTGTCCC<br>TGCGTCCGGAGGCATGTAGACCCGCAGCTGGTG<br>GGGCCGTGCATACCCGGGGTCTTGACTTCGCCTG<br>CGATATCTACATTTGGGCCCCTCTGGCTGGTACT<br>TGCGGGGTCCTGCTGCTTTCACTCGTGATCACTC<br>TTTACTGTAAGCGCGGTCGGAAGAAGCTGCTGTA<br>CATCTTTAAGCAACCCTTCATGAGGCCTGTGCAG<br>ACTACTCAAGAGGAGGACGGCTGTTCATGCCGG<br>TTCCCAGAGGAGGAGGAAGGCGGCTGCGAACTG<br>CGCGTGAAATTCAGCCGCAGCGCAGATGCTCCA<br>GCCTACCAGCAGGGGCAGAACCAGCTCTACAAC<br>GAACTCAATCTTGGTCGGAGAGAGGAGTACGAC<br>GTGCTGGACAAGCGGAGAGGACGGGACCCAGAA<br>ATGGGCGGGAAGCCGCGCAGAAAGAATCCCCAA<br>GAGGGCCTGTACAACGAGCTCCAAAAGGATAAG<br>ATGGCAGAAGCCTATAGCGAGATTGGTATGAAA<br>GGGGAACGCAGAAGAGGCAAAGGCCACGACGG<br>ACTGTACCAGGGACTCAGCACCGCCACCAAGGA<br>CACCTATGACGCTCTTCACATGCAGGCCCTGCCG<br>CCTCGG |

CD20-C3H4

| SEQ ID NO: 190 (Kabat) | HCDR1 | NYNLH |
| SEQ ID NO: 191 (Kabat) | HCDR2 | AIYPGNYDTSYNQKFKG |
| SEQ ID NO: 192 (Kabat) | HCDR3 | VDFGHSRYWYFDV |
| SEQ ID NO: 193 (Chothia) | HCDR1 | GYTFTNY |
| SEQ ID NO: 194 (Chothia) | HCDR2 | YPGNYD |

TABLE 1-continued

CD20 CAR Constructs

| SEQ ID NUMBER | Ab region | Sequence |
| --- | --- | --- |
| SEQ ID NO: 195 (Chothia) | HCDR3 | VDFGHSRYWYFDV |
| SEQ ID NO: 196 (IMGT) | HCDR1 | GYTFTNYN |
| SEQ ID NO: 197 (IMGT) | HCDR2 | IYPGNYDT |
| SEQ ID NO: 198 (IMGT) | HCDR3 | ARVDFGHSRYWYFDV |
| SEQ ID NO: 935 (Combined Chothia and Kabat) | HCDR1 | GYTFTNYNLH |
| SEQ ID NO: 936 (Combined Chothia and Kabat) | HCDR2 | AIYPGNYDTSYNQKFKG |
| SEQ ID NO: 937 (Combined Chothia and Kabat) | HCDR3 | VDFGHSRYWYFDV |
| SEQ ID NO: 199 | VH | QVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSS |
| SEQ ID NO: 200 | DNA VH | CAAGTCCAACTCGTCCAGTCGGGAGCAGAAGTCAAGAAGCCCGGATCATCCGTGAAAGTGTCCTGCAAAGCCTCAGGCTACACCTTTACCAACTACAACTTGCACTGGGTCAGACAGGCCCCGGGACAGGGCCTGGAGTGGATGGGCGCCATCTACCCCGGAAACTATGACACCTCGTACAACCAGAAGTTCAAGGGTCGCGTGACTATCACGGCTGACAAGTCCACTAGCACCGCGTACATGGAACTTTCCTCACTGCGGTCCGAGGATACTGCGGTGTACTACTGCGCCCGGGTGGACTTCGGACACTCGAGATATTGGTACTTCGATGTCTGGGGACAGGGGACCACCGTGACTGTGTCCTCC |
| SEQ ID NO: 201 (Kabat) | LCDR1 | RATSSVSSMN |
| SEQ ID NO: 202 (Kabat) | LCDR2 | ATSNLAS |
| SEQ ID NO: 203 (Kabat) | LCDR3 | QQWTFNPPT |
| SEQ ID NO: 204 (Chothia) | LCDR1 | TSSVSS |
| SEQ ID NO: 205 (Chothia) | LCDR2 | ATS |
| SEQ ID NO: 206 (Chothia) | LCDR3 | WTFNPP |
| SEQ ID NO: 207 (IMGT) | LCDR1 | SSVSS |
| SEQ ID NO: 208 (IMGT) | LCDR2 | ATS |
| SEQ ID NO: 209 (IMGT) | LCDR3 | QQWTFNPPT |

TABLE 1-continued

CD20 CAR Constructs

| SEQ ID NUMBER | Ab region | Sequence |
|---|---|---|
| SEQ ID NO: 938 (Combined Chothia and Kabat) | LCDR1 | RATSSVSSMN |
| SEQ ID NO: 939 (Combined Chothia and Kabat) | LCDR2 | ATSNLAS |
| SEQ ID NO: 940 (Combined Chothia and Kabat) | LCDR3 | QQWTFNPPT |
| SEQ ID NO: 210 | VL | EIVLTQSPATLSLSPGERATLSCRATSSVSSMNWYQ QKPGQAPRPLIHATSNLASGIPARFSGSGSGTDYTL TISSLEPEDAAVYYCQQWTFNPPTFGQGTKLEIK |
| SEQ ID NO: 211 | DNA VL | GAAATTGTGCTGACCCAGTCTCCCGCAACCCTGT CCCTGAGCCCTGGAGAGCGCGCCACCCTGTCCTG CCGGGCCACATCCTCCGTGTCGTCCATGAACTGG TACCAGCAGAAGCCCGGCCAAGCCCCGAGGCCT CTGATTCATGCTACCTCAAATCTGGCCAGCGGAA TCCCGGCGCGCTTCTCCGGCTCGGGCAGCGGTAC TGACTACACTCTCACCATCTCGTCCCTCGAACCG GAGGACGCCGCCGTCTACTACTGTCAGCAGTGG ACCTTCAACCCACCTACTTTCGGACAAGGGACCA AGCTGGAGATCAAG |
| SEQ ID NO: 212 | Linker | GGGGSGGGGSGGGGSGGGGS |
| SEQ ID NO: 213 | scFv (VH-linker-VL) | QVQLVQSGAEVKKPGSSVKVSCKASGYTFTNYNL HWVRQAPGQGLEWMGAIYPGNYDTSYNQKFKGR VTITADKSTSTAYMELSSLRSEDTAVYYCARVDFG HSRYWYFDVWGQGTTVTVSSGGGGSGGGGSGGG GSGGGGSEIVLTQSPATLSLSPGERATLSCRATSSVS SMNWYQQKPGQAPRPLIHATSNLASGIPARFSGSG SGTDYTLTISSLEPEDAAVYYCQQWTFNPPTFGQG TKLEIK |
| SEQ ID NO: 214 | DNA scFv (VH-linker-VL) | CAAGTCCAACTCGTCCAATCCGGCGCAGAAGTCAAG AAACCAGGATCGTCCGTGAAAGTGTCCTGCAAGGCG TCCGGGTACACCTTCACTAATTACAACCTCCACTGGG TCAGACAGGCCCCAGGACAGGGCCTGGAATGGATGG GCGCCATCTACCCTGGAAACTACGATACCTCGTACAA CCAGAAGTTCAAGGGCCGCGTGACTATTACCGCCGA CAAGAGCACCTCCACCGCCTATATGGAACTGTCGTCC CTGCGGTCCGAGGACACTGCCGTGTACTACTGTGCAA GGGTGGACTTCGGTCACTCCCGGTATTGGTACTTCGA CGTCTGGGGACAGGGGACCACTGTGACCGTGTCGTC GGGAGGCGGTGGAAGCGGCGGTGGCGGAAGCGGAG GCGGCGGATCAGGGGGCGGAGGAAGCGACATTCAGC TTACCCAGTCACCGTCCTTCCTGAGCGCCTCCGTGGG AGATCGCGTGACCATCACATGCCGCGCCACTTCCTCG GTGTCCTCCATGAACTGGTACCAGCAGAAGCCCGGA AAGGCTCCTAAGCCTCTGATCCATGCGACCTCCAACT TGGCTTCCGGGGTGCCGTCACGGTTCAGCGGCAGCGG TTCAGGAACTGAGTACACCCTGACTATTAGCTCTCTC CAACCCGAGGACTTCGCCACCTACTACTGCCAGCAGT GGACCTTCAACCCGCCCACGTTTGGGCAGGGTACCAA GCTGGAGATCAAG |
| SEQ ID NO: 215 | Full CAR amino acid sequence | MALPVTALLLPLALLLHAARPQVQLVQSGAEVKK PGSSVKVSCKASGYTFTNYNLHWVRQAPGQGLEW MGAIYPGNYDTSYNQKFKGRVTITADKSTSTAYM ELSSLRSEDTAVYYCARVDFGHSRYWYFDVWGQG TTVTVSSGGGGSGGGGSGGGGSGGGGSDIQLTQSP SFLSASVGDRVTITCRATSSVSSMNWYQQKPGKAP KPLIHATSNLASGVPSRFSGSGSGTEYTLTISSLQPE DFATYYCQQWTFNPPTFGQGTKLEIKTTTPAPRPPT PAPTIASQPLSLRPEACRPAAGGAVHTRGLDFACDI YIWAPLAGTCGVLLLSLVITLYCKRGRKKLLYIFKQ |

TABLE 1-continued

CD20 CAR Constructs

| SEQ ID NUMBER | Ab region | Sequence |
|---|---|---|
| | | PFMRPVQTTQEEDGCSCRFPEEEEGGCELRVKFSRS ADAPAYQQGQNQLYNELNLGRREEYDVLDKRRG RDPEMGGKPRRKNPQEGLYNELQKDKMAEAYSEI GMKGERRRGKGHDGLYQGLSTATKDTYDALHMQ ALPPR |
| SEQ ID NO: 216 | Full CAR nucleic acid sequence | ATGGCCCTCCCTGTCACCGCCCTGCTGCTTCCGC TGGCTCTTCTGCTCCACGCCGCTCGGCCCCAAGT CCAACTCGTCCAATCCGGCGCAGAAGTCAAGAA ACCAGGATCGTCCGTGAAAGTGTCCTGCAAGGC GTCCGGGTACACCTTCACTAATTACAACCTCCAC TGGGTCAGACAGGCCCCAGGACAGGGCCTGGAA TGGATGGGCGCCATCTACCCTGGAAACTACGAT ACCTCGTACAACCAGAAGTTCAAGGGCCGCGTG ACTATTACCGCCGACAAGAGCACCTCCACCGCCT ATATGGAACTGTCGTCCCTGCGGTCCGAGGACAC TGCCGTGTACTACTGTGCAAGGGTGGACTTCGGT CACTCCCGGTATTGGTACTTCGACGTCTGGGGAC AGGGGACCACTGTGACCGTGTCGTCGGGAGGCG GTGGAAGCGGCGGTGGCGGAAGCGGAGGCGGC GGATCAGGGGGCGGAGGAAGCGACATTCAGCTT ACCCAGTCACCGTCCTTCCTGAGCGCCTCCGTGG GAGATCGCGTGACCATCACATGCCGCGCCACTTC CTCGGTGTCCTCCATGAACTGGTACCAGCAGAAG CCCGGAAAGGCTCCTAAGCCTCTGATCCATGCGA CCTCCAACTTGGCTTCCGGGGTGCCGTCACGGTT CAGCGGCAGCGGTTCAGGAACTGAGTACACCCT GACTATTAGCTCTCTCCAACCCGAGGACTTCGCC ACCTACTACTGCCAGCAGTGGACCTTCAACCCGC CCACGTTTGGGCAGGGTACCAAGCTGGAGATCA AGACCACTACCCCAGCACCGAGGCCACCCACCC CGGCTCCTACCATCGCCTCCCAGCCTCTGTCCCT GCGTCCGGAGGCATGTAGACCCGCAGCTGGTGG GGCCGTGCATACCCGGGGTCTTGACTTCGCCTGC GATATCTACATTTGGGCCCCTCTGGCTGGTACTT GCGGGGTCCTGCTGCTTTCACTCGTGATCACTCT TTACTGTAAGCGCGGTCGGAAGAAGCTGCTGTA CATCTTTAAGCAACCCTTCATGAGGCCTGTGCAG ACTACTCAAGAGGAGGACGGCTGTTCATGCCGG TTCCCAGAGGAGGAGGAAGGCGGCTGCGAACTG CGCGTGAAATTCAGCCGCAGCGCAGATGCTCCA GCCTACCAGCAGGGGCAGAACCAGCTCTACAAC GAACTCAATCTTGGTCGGAGAGAGGAGTACGAC GTGCTGGACAAGCGGAGAGGACGGGACCCAGAA ATGGGCGGGAAGCCGCGCAGAAAGAATCCCCAA GAGGGCCTGTACAACGAGCTCCAAAAGGATAAG ATGGCAGAAGCCTATAGCGAGATTGGTATGAAA GGGGAACGCAGAAGAGGCAAAGGCCACGACGG ACTGTACCAGGGACTCAGCACCGCCACCAAGGA CACCTATGACGCTCTTCACATGCAGGCCCTGCCG CCTCGG |

CD20-C5H2

| SEQ ID NO: 244 (Kabat) | HCDR1 | SYNMH |
| SEQ ID NO: 245 (Kabat) | HCDR2 | AIYPGNGDTSYNPKFKG |
| SEQ ID NO: 246 (Kabat) | HCDR3 | SYFYGSSSWYFDV |
| SEQ ID NO: 247 (Chothia) | HCDR1 | GYTFTSY |
| SEQ ID NO: 248 (Chothia) | HCDR2 | YPGNGD |
| SEQ ID NO: 249 (Chothia) | HCDR3 | SYFYGSSSWYFDV |
| SEQ ID NO: 250 (IMGT) | HCDR1 | GYTFTSYN |

TABLE 1-continued

CD20 CAR Constructs

| SEQ ID NUMBER | Ab region | Sequence |
|---|---|---|
| SEQ ID NO: 251 (IMGT) | HCDR2 | IYPGNGDT |
| SEQ ID NO: 252 (IMGT) | HCDR3 | ARSYFYGSSSWYFDV |
| SEQ ID NO: 946 (Combined Chothia and Kabat) | HCDR1 | GYTFTSYNMH |
| SEQ ID NO: 947 (Combined Chothia and Kabat) | HCDR2 | AIYPGNGDTSYNPKFKG |
| SEQ ID NO: 948 (Combined Chothia and Kabat) | HCDR3 | SYFYGSSSWYFDV |
| SEQ ID NO: 253 | VH | QVQLVQSGAEVKKPGASVKVSCKASGYTFTSYNM HWVRQAPGQGLEWMGAIYPGNGDTSYNPKFKGR VTMTADKSTRTAYMELSSLRSEDTAVYYCARSYF YGSSSWYFDVWGQGTTVTVSS |
| SEQ ID NO: 254 | DNA VH | CAAGTCCAACTCGTCCAGTCAGGAGCAGAAGTC AAGAAACCTGGAGCTTCCGTGAAAGTGTCGTGC AAGGCCTCCGGCTACACCTTCACCTCTTACAACA TGCACTGGGTCAGACAGGCCCCTGGTCAAGGAC TGGAATGGATGGGAGCGATCTACCCGGGCAACG GAGACACTTCGTACAACCCCAAGTTCAAGGGAC GGGTCACTATGACCGCCGATAAGAGCACGCGCA CCGCGTACATGGAACTGAGCAGCCTGCGCTCCG AGGACACTGCCGTGTATTACTGCGCGAGGAGCT ACTTCTACGGATCATCGTCGTGGTACTTCGACGT CTGGGGCCAGGGCACCACCGTGACCGTGTCATCC |
| SEQ ID NO: 255 (Kabat) | LCDR1 | RASSSVSSMH |
| SEQ ID NO: 256 (Kabat) | LCDR2 | ATSNLAS |
| SEQ ID NO: 257 (Kabat) | LCDR3 | QQWIFNPPT |
| SEQ ID NO: 258 (Chothia) | LCDR1 | SSSVSS |
| SEQ ID NO: 259 (Chothia) | LCDR2 | ATS |
| SEQ ID NO: 260 (Chothia) | LCDR3 | WIFNPP |
| SEQ ID NO: 261 (IMGT) | LCDR1 | SSVSS |
| SEQ ID NO: 262 (IMGT) | LCDR2 | ATS |
| SEQ ID NO: 263 (IMGT) | LCDR3 | QQWIFNPPT |
| SEQ ID NO: 949 (Combined Chothia and Kabat) | LCDR1 | RASSSVSSMH |
| SEQ ID NO: 950 (Combined Chothia and Kabat) | LCDR2 | ATSNLAS |

TABLE 1-continued

CD20 CAR Constructs

| SEQ ID NUMBER | Ab region | Sequence |
|---|---|---|
| SEQ ID NO: 951 (Combined Chothia and Kabat) | LCDR3 | QQWIFNPPT |
| SEQ ID NO: 264 | VL | DIQLTQSPSFLSASVGDRVTITCRASSSVSSMHWYQ QKPGKAPKPLIFATSNLASGVPSRFSGSGSGTEYTL TISSLQPEDFATYYCQQWIFNPPTFGGGTKVEIK |
| SEQ ID NO: 265 | DNA VL | GATATTCAGCTGACCCAGAGCCCGTCATTCCTGT CCGCCTCCGTGGGAGACAGAGTGACCATCACTT GTCGGGCCAGCTCCTCGGTGTCCTCCATGCATTG GTATCAGCAGAAGCCTGGGAAGGCTCCCAAGCC CCTCATCTTCGCCACATCAAATCTTGCCTCCGGG GTGCCAAGCCGGTTCTCCGGGAGCGGCTCCGGT ACTGAGTACACTCTGACCATTTCCTCCTTGCAAC CCGAGGACTTTGCCACCTACTACTGCCAGCAGTG GATCTTTAACCCGCCGACCTTCGGAGGAGGAAC CAAAGTGGAGATCAAG |
| SEQ ID NO: 266 | Linker | GGGGSGGGGSGGGGSGGGGS |
| SEQ ID NO: 267 | scFv (VH-linker-VL) | QVQLVQSGAEVKKPGASVKVSCKASGYTFTSYNM HWVRQAPGQGLEWMGAIYPGNGDTSYNPKFKGR VTMTADKSTRTAYMELSSLRSEDTAVYYCARSYF YGSSSWYFDVWGQGTTVTVSSGGGGSGGGGSGG GGSGGGGSDIQLTQSPSFLSASVGDRVTITCRASSS VSSMHWYQQKPGKAPKPLIFATSNLASGVPSRFSG SGSGTEYTLTISSLQPEDFATYYCQQWIFNPPTFGG GTKVEIK |
| SEQ ID NO: 268 | DNA scFv (VH-linker-VL) | CAAGTCCAACTCGTCCAGTCAGGAGCAGAAGTCAAG AAACCTGGAGCTTCCGTGAAAGTGTCGTGCAAGGCCT CCGGCTACACCTTCACCTCTTACAACATGCACTGGGT CAGACAGGCCCCTGGTCAAGGACTGGAATGGATGGG AGCGATCTACCCGGGCAACGGAGACACTTCGTACAA CCCCAAGTTCAAGGGACGGGTCACTATGACCGCCGA TAAGAGCACGCGCACCGCGTACATGGAACTGAGCAG CCTGCGCTCCGAGGACACTGCCGTGTATTACTGCGCG AGGAGCTACTTCTACGGATCATCGTCGTGGTACTTCG ACGTCTGGGGCCAGGGCACCACCGTGACCGTGTCATC CGGTGGCGGAGGATCGGGGGGCGGAGGAAGCGGCG GGGGGGGCTCCGGCGGTGGAGGCTCGGATATTCAGC TGACCCAGAGCCCGTCATTCCTGTCCGCCTCCGTGGG AGACAGAGTGACCATCACTTGTCGGGCCAGCTCCTCG GTGTCCTCCATGCATTGGTATCAGCAGAAGCCTGGGA AGGCTCCCAAGCCCCTCATCTTCGCCACATCAAATCT TGCCTCCGGGGTGCCAAGCCGGTTCTCCGGGAGCGGC TCCGGTACTGAGTACACTCTGACCATTTCCTCCTTGC AACCCGAGGACTTTGCCACCTACTACTGCCAGCAGTG GATCTTTAACCCGCCGACCTTCGGAGGAGGAACCAA AGTGGAGATCAAG |
| SEQ ID NO: 269 | Full CAR amino acid sequence | MALPVTALLLPLALLLHAARPQVQLVQSGAEVKK PGASVKVSCKASGYTFTSYNMHWVRQAPGQGLE WMGAIYPGNGDTSYNPKFKGRVTMTADKSTRTAY MELSSLRSEDTAVYYCARSYFYGSSSWYFDVWGQ GTTVTVSSGGGGSGGGGSGGGGSGGGGSDIQLTQS PSFLSASVGDRVTITCRASSSVSSMHWYQQKPGKA PKPLIFATSNLASGVPSRFSGSGSGTEYTLTISSLQPE DFATYYCQQWIFNPPTFGGGTKVEIKTTTPAPRPPT PAPTIASQPLSLRPEACRPAAGGAVHTRGLDFACDI YIWAPLAGTCGVLLLSLVITLYCKRGRKKLLYIFKQ PFMRPVQTTQEEDGCSCRFPEEEEGGCELRVKFSRS ADAPAYQQGQNQLYNELNLGRREEYDVLDKRRG RDPEMGGKPRRKNPQEGLYNELQKDKMAEAYSEI GMKGERRRGKGHDGLYQGLSTATKDTYDALHMQ ALPPR |
| SEQ ID NO: 270 | Full CAR nucleic acid sequence | ATGGCCCTCCCTGTCACCGCCCTGCTGCTTCCGC TGGCTCTTCTGCTCCACGCCGCTCGGCCCCAAGT CCAACTCGTCCAGTCAGGAGCAGAAGTCAAGAA ACCTGGAGCTTCCGTGAAAGTGTCGTGCAAGGC |

TABLE 1-continued

CD20 CAR Constructs

| SEQ ID NUMBER | Ab region | Sequence |
|---|---|---|
| | | CTCCGGCTACACCTTCACCTCTTACAACATGCAC
TGGGTCAGACAGGCCCCTGGTCAAGGACTGGAA
TGGATGGGAGCGATCTACCCGGGCAACGGAGAC
ACTTCGTACAACCCCAAGTTCAAGGGACGGGTC
ACTATGACCGCCGATAAGAGCACGCGCACCGCG
TACATGGAACTGAGCAGCCTGCGCTCCGAGGAC
ACTGCCGTGTATTACTGCGCGAGGAGCTACTTCT
ACGGATCATCGTCGTGGTACTTCGACGTCTGGGG
CCAGGGCACCACCGTGACCGTGTCATCCGGTGG
CGGAGGATCGGGGGGCGGAGGAAGCGGCGGGG
GGGGCTCCGGCGGTGGAGGCTCGGATATTCAGC
TGACCCAGAGCCCGTCATTCCTGTCCGCCTCCGT
GGGAGACAGAGTGACCATCACTTGTCGGGCCAG
CTCCTCGGTGTCCTCCATGCATTGGTATCAGCAG
AAGCCTGGGAAGGCTCCCAAGCCCCTCATCTTCG
CCACATCAAATCTTGCCTCCGGGGTGCCAAGCCG
GTTCTCCGGGAGCGGCTCCGGTACTGAGTACACT
CTGACCATTTCCTCCTTGCAACCCGAGGACTTTG
CCACCTACTACTGCCAGCAGTGGATCTTTAACCC
GCCGACCTTCGGAGGAGGAACCAAAGTGGAGAT
CAAGACCACTACCCCAGCACCGAGGCCACCCAC
CCCGGCTCCTACCATCGCCTCCCAGCCTCTGTCC
CTGCGTCCGGAGGCATGTAGACCCGCAGCTGGT
GGGGCCGTGCATACCCGGGGTCTTGACTTCGCCT
GCGATATCTACATTTGGGCCCCTCTGGCTGGTAC
TTGCGGGGTCCTGCTGCTTTCACTCGTGATCACT
CTTTACTGTAAGCGCGGTCGGAAGAAGCTGCTGT
ACATCTTTAAGCAACCCTTCATGAGGCCTGTGCA
GACTACTCAAGAGGAGGACGGCTGTTCATGCCG
GTTCCCAGAGGAGGAGGAAGGCGGCTGCGAACT
GCGCGTGAAATTCAGCCGCAGCGCAGATGCTCC
AGCCTACCAGCAGGGGCAGAACCAGTCTACAA
CGAACTCAATCTTGGTCGGAGAGAGGAGTACGA
CGTGCTGGACAAGCGGAGAGGACGGGACCCAGA
AATGGGCGGGAAGCCGCGCAGAAAGAATCCCCA
AGAGGGCCTGTACAACGAGCTCCAAAAGGATAA
GATGGCAGAAGCCTATAGCGAGATTGGTATGAA
AGGGGAACGCAGAAGAGGCAAAGGCCACGACG
GACTGTACCAGGGACTCAGCACCGCCACCAAGG
ACACCTATGACGCTCTTCACATGCAGGCCCTGCC
GCCTCGG |

CD20-C5H3

| SEQ ID NO: 271 (Kabat) | HCDR1 | SYNMH |
| SEQ ID NO: 272 (Kabat) | HCDR2 | AIYPGNGDTSYNPKFKG |
| SEQ ID NO: 273 (Kabat) | HCDR3 | SYFYGSSSWYFDV |
| SEQ ID NO: 274 (Chothia) | HCDR1 | GYTFTSY |
| SEQ ID NO: 275 (Chothia) | HCDR2 | YPGNGD |
| SEQ ID NO: 276 (Chothia) | HCDR3 | SYFYGSSSWYFDV |
| SEQ ID NO: 277 (IMGT) | HCDR1 | GYTFTSYN |
| SEQ ID NO: 278 (IMGT) | HCDR2 | IYPGNGDT |
| SEQ ID NO: 279 (IMGT) | HCDR3 | ARSYFYGSSSWYFDV |
| SEQ ID NO: 952 (Combined Chothia and Kabat) | HCDR1 | GYTFTSYNMH |

TABLE 1-continued

CD20 CAR Constructs

| SEQ ID NUMBER | Ab region | Sequence |
|---|---|---|
| SEQ ID NO: 953 (Combined Chothia and Kabat) | HCDR2 | AIYPGNGDTSYNPKFKG |
| SEQ ID NO: 954 (Combined Chothia and Kabat) | HCDR3 | SYFYGSSSWYFDV |
| SEQ ID NO: 280 | VH | QVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSS |
| SEQ ID NO: 281 | DNA VH | CAAGTGCAACTCGTCCAGTCCGGTGCAGAAGTCAAGAAGCCTGGTTCATCGGTGAAAGTGTCCTGCAAAGCGTCGGGCTACACCTTCACCTCGTACAACATGCACTGGGTCCGCCAGGCCCCCGGACAAGGACTGGAATGGATGGGTGCTATCTACCCCGGAAACGGAGATACCAGCTACAACCCCAAGTTCAAGGGACGCGTGACCATTACTGCCGACAAGTCCACAAGAACCGCCTACATGGAACTGTCCAGCCTGAGATCCGAGGACACTGCGGTGTACTACTGTGCGAGGTCCTACTTCTACGGGTCCTCCTCTTGGTACTTCGACGTCTGGGGACAGGGCACTACTGTGACCGTGTCCAGC |
| SEQ ID NO: 282 (Kabat) | LCDR1 | RASSSVSSMH |
| SEQ ID NO: 283 (Kabat) | LCDR2 | ATSNLAS |
| SEQ ID NO: 284 (Kabat) | LCDR3 | QQWIFNPPT |
| SEQ ID NO: 285 (Chothia) | LCDR1 | SSSVSS |
| SEQ ID NO: 286 (Chothia) | LCDR2 | ATS |
| SEQ ID NO: 287 (Chothia) | LCDR3 | WIFNPP |
| SEQ ID NO: 288 (IMGT) | LCDR1 | SSVSS |
| SEQ ID NO: 289 (IMGT) | LCDR2 | ATS |
| SEQ ID NO: 290 (IMGT) | LCDR3 | QQWIFNPPT |
| SEQ ID NO: 955 (Combined Chothia and Kabat) | LCDR1 | RASSSVSSMH |
| SEQ ID NO: 956 (Combined Chothia and Kabat) | LCDR2 | ATSNLAS |
| SEQ ID NO: 957 (Combined Chothia and Kabat) | LCDR3 | QQWIFNPPT |
| SEQ ID NO: 291 | VL | EIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK |

TABLE 1-continued

CD20 CAR Constructs

| SEQ ID NUMBER | Ab region | Sequence |
|---|---|---|
| SEQ ID NO: 292 | DNA VL | GAGATCGTGCTGACGCAGTCGCCGGCCACCCTG<br>AGCCTTTCACCGGGAGAACGCGCCACTCTGTCAT<br>GCCGGGCCAGCAGCTCCGTGTCCTCCATGCATTG<br>GTACCAGCAGAAGCCGGGCAGGCCCCGCGGCC<br>TCTCATCTTCGCCACCTCCAATCTGGCCTCCGGC<br>ATCCCTGCTCGGTTTAGCGGAAGCGGCAGCGGA<br>ACTGACTATACCTTGACCATCTCCTCGCTGGAAC<br>CAGAGGATGCAGCCGTGTACTATTGCCAGCAGT<br>GGATCTTCAACCCGCCAACCTTCGGCGGCGGCAC<br>CAAGGTCGAGATTAAG |
| SEQ ID NO: 293 | Linker | GGGGSGGGGSGGGGSGGGGS |
| SEQ ID NO: 294 | scFv (VH-linker-VL) | QVQLVQSGAEVKKPGSSVKVSCKASGYTFTSYNM<br>HWVRQAPGQGLEWMGAIYPGNGDTSYNPKFKGR<br>VTITADKSTRTAYMELSSLRSEDTAVYYCARSYFY<br>GSSSWYFDVWGQGTTVTVSSGGGGSGGGGSGGG<br>GSGGGGSEIVLTQSPATLSLSPGERATLSCRASSSVS<br>SMHWYQQKPGQAPRPLIFATSNLASGIPARFSGSGS<br>GTDYTLTISSLEPEDAAVYYCQQWIFNPPTFGGGTK<br>VEIK |
| SEQ ID NO: 295 | DNA scFv (VH-linker-VL) | CAAGTGCAACTCGTCCAGTCCGGTGCAGAAGTCAAG<br>AAGCCTGGTTCATCGGTGAAAGTGTCCTGCAAAGCGT<br>CGGGCTACACCTTCACCTCGTACAACATGCACTGGGT<br>CCGCCAGGCCCCCGGACAAGGACTGGAATGGATGGG<br>TGCTATCTACCCCGGAAACGGAGATACCAGCTACAA<br>CCCCAAGTTCAAGGGACGCGTGACCATTACTGCCGAC<br>AAGTCCACAAGAACCGCCTACATGGAACTGTCCAGC<br>CTGAGATCCGAGGACACTGCGGTGTACTACTGTGCGA<br>GGTCCTACTTCTACGGGTCCTCCTCTTGGTACTTCGAC<br>GTCTGGGGACAGGGCACTACTGTGACCGTGTCCAGC<br>GGGGGAGGCGGTAGCGGGGGGGGTGGATCGGGCGG<br>CGGCGGATCAGGAGGAGGAGGGTCCGAGATCGTGCT<br>GACGCAGTCGCCGGCCACCCTGAGCCTTTCACCGGGA<br>GAACGCGCCACTCTGTCATGCCGGGCCAGCAGCTCCG<br>TGTCCTCCATGCATTGGTACCAGCAGAAGCCGGGGCA<br>GGCCCCGCGGCCTCTCATCTTCGCCACCTCCAATCTG<br>GCCTCCGGCATCCCTGCTCGGTTTAGCGGAAGCGGCA<br>GCGGAACTGACTATACCTTGACCATCTCCTCGCTGGA<br>ACCAGAGGATGCAGCCGTGTACTATTGCCAGCAGTG<br>GATCTTCAACCCGCCAACCTTCGGCGGCGGCACCAAG<br>GTCGAGATTAAG |
| SEQ ID NO: 296 | Full CAR amino acid sequence | MALPVTALLLPLALLLHAARPQVQLVQSGAEVKK<br>PGSSVKVSCKASGYTFTSYNMHWVRQAPGQGLE<br>WMGAIYPGNGDTSYNPKFKGRVTITADKSTRTAY<br>MELSSLRSEDTAVYYCARSYFYGSSSWYFDVWGQ<br>GTTVTVSSGGGGSGGGGSGGGGSGGGGSEIVLTQS<br>PATLSLSPGERATLSCRASSSVSSMHWYQQKPGQA<br>PRPLIFATSNLASGIPARFSGSGSGTDYTLTISSLEPE<br>DAAVYYCQQWIFNPPTFGGGTKVEIKTTTPAPRPPT<br>PAPTIASQPLSLRPEACRPAAGGAVHTRGLDFACDI<br>YIWAPLAGTCGVLLLSLVITLYCKRGRKKLLYIFKQ<br>PFMRPVQTTQEEDGCSCRFPEEEEGGCELRVKFSRS<br>ADAPAYQQGQNQLYNELNLGRREEYDVLDKRRG<br>RDPEMGGKPRRKNPQEGLYNELQKDKMAEAYSEI<br>GMKGERRRGKGHDGLYQGLSTATKDTYDALHMQ<br>ALPPR |
| SEQ ID NO: 297 | Full CAR nucleic acid sequence | ATGGCCCTCCCTGTCACCGCCCTGCTGCTTCCGC<br>TGGCTCTTCTGCTCCACGCCGCTCGGCCCCAAGT<br>GCAACTCGTCCAGTCCGGTGCAGAAGTCAAGAA<br>GCCTGGTTCATCGGTGAAAGTGTCCTGCAAAGCG<br>TCGGGCTACACCTTCACCTCGTACAACATGCACT<br>GGGTCCGCCAGGCCCCCGGACAAGGACTGGAAT<br>GGATGGGTGCTATCTACCCCGGAAACGGAGATA<br>CCAGCTACAACCCCAAGTTCAAGGGACGCGTGA<br>CCATTACTGCCGACAAGTCCACAAGAACCGCCT<br>ACATGGAACTGTCCAGCCTGAGATCCGAGGACA<br>CTGCGGTGTACTACTGTGCGAGGTCCTACTTCTA<br>CGGGTCCTCCTCTTGGTACTTCGACGTCTGGGGA<br>CAGGGCACTACTGTGACCGTGTCCAGCGGGGGA |

TABLE 1-continued

CD20 CAR Constructs

| SEQ ID NUMBER | Ab region | Sequence |
|---|---|---|
| | | GGCGGTAGCGGGGGGGTGGATCGGGCGGCGGC
GGATCAGGAGGAGGAGGGTCCGAGATCGTGCTG
ACGCAGTCGCCGGCCACCCTGAGCCTTTCACCGG
GAGAACGCGCCACTCTGTCATGCCGGGCCAGCA
GCTCCGTGTCCTCCATGCATTGGTACCAGCAGAA
GCCGGGGCAGGCCCCGCGGCCTCTCATCTTCGCC
ACCTCCAATCTGGCCTCCGGCATCCCTGCTCGGT
TTAGCGGAAGCGGCAGCGGAACTGACTATACCT
TGACCATCTCCTCGCTGGAACCAGAGGATGCAG
CCGTGTACTATTGCCAGCAGTGGATCTTCAACCC
GCCAACCTTCGGCGGCGGCACCAAGGTCGAGAT
TAAGACCACTACCCCAGCACCGAGGCCACCCAC
CCCGGCTCCTACCATCGCCTCCCAGCCTCTGTCC
CTGCGTCCGGAGGCATGTAGACCCGCAGCTGGT
GGGGCCGTGCATACCCGGGGTCTTGACTTCGCCT
GCGATATCTACATTTGGGCCCCTCTGGCTGGTAC
TTGCGGGGTCCTGCTGCTTTCACTCGTGATCACT
CTTTACTGTAAGCGCGGTCGGAAGAAGCTGCTGT
ACATCTTTAAGCAACCCTTCATGAGGCCTGTGCA
GACTACTCAAGAGGAGGACGGCTGTTCATGCCG
GTTCCCAGAGGAGGAGGAAGGCGGCTGCGAACT
GCGCGTGAAATTCAGCCGCAGCGCAGATGCTCC
AGCCTACCAGCAGGGGCAGAACCAGCTCTACAA
CGAACTCAATCTTGGTCGGAGAGAGGAGTACGA
CGTGCTGGACAAGCGGAGAGGACGGGACCCAGA
AATGGGCGGGAAGCCGCGCAGAAAGAATCCCCA
AGAGGGCCTGTACAACGAGCTCCAAAAGGATAA
GATGGCAGAAGCCTATAGCGAGATTGGTATGAA
AGGGGAACGCAGAAGAGGCAAAGGCCACGACG
GACTGTACCAGGGACTCAGCACCGCCACCAAGG
ACACCTATGACGCTCTTCACATGCAGGCCCTGCC
GCCTCGG |

CD20-C5H4

| SEQ ID NO: 298 (Kabat) | HCDR1 | SYNMH |
| SEQ ID NO: 299 (Kabat) | HCDR2 | AIYPGNGDTSYNPKFKG |
| SEQ ID NO: 300 (Kabat) | HCDR3 | SYFYGSSSWYFDV |
| SEQ ID NO: 301 (Chothia) | HCDR1 | GYTFTSY |
| SEQ ID NO: 302 (Chothia) | HCDR2 | YPGNGD |
| SEQ ID NO: 303 (Chothia) | HCDR3 | SYFYGSSSWYFDV |
| SEQ ID NO: 304 (IMGT) | HCDR1 | GYTFTSYN |
| SEQ ID NO: 305 (IMGT) | HCDR2 | IYPGNGDT |
| SEQ ID NO: 306 (IMGT) | HCDR3 | ARSYFYGSSSWYFDV |
| SEQ ID NO: 958 (Combined Chothia and Kabat) | HCDR1 | GYTFTSYNMH |
| SEQ ID NO: 959 (Combined Chothia and Kabat) | HCDR2 | AIYPGNGDTSYNPKFKG |
| SEQ ID NO: 960 (Combined Chothia and Kabat) | HCDR3 | SYFYGSSSWYFDV |

TABLE 1-continued

CD20 CAR Constructs

| SEQ ID NUMBER | Ab region | Sequence |
|---|---|---|
| SEQ ID NO: 307 | VH | QVQLVQSGAEVKKPGSSVKVSCKASGYTFTSYNM HWVRQAPGQGLEWMGAIYPGNGDTSYNPKFKGR VTITADKSTRTAYMELSSLRSEDTAVYYCARSYFY GSSSWYFDVWGQGTTVTVSS |
| SEQ ID NO: 308 | DNA VH | CAAGTGCAACTCGTCCAGTCCGGTGCAGAAGTC AAGAAGCCAGGTTCCTCGGTGAAAGTGTCCTGC AAAGCCTCGGGTTACACCTTCACCTCGTACAATA TGCACTGGGTCCGCCAAGCTCCGGGACAAGGCC TGGAATGGATGGGAGCGATCTACCCCGGAAACG GCGACACGTCCTACAACCCGAAGTTCAAGGGAA GAGTGACCATCACCGCCGACAAGTCCACCCGCA CCGCGTACATGGAGCTTAGCAGCCTGCGGAGCG AGGACACTGCCGTGTATTACTGCGCCCGGTCCTA CTTCTATGGATCATCCTCGTGGTACTTCGATGTCT GGGGCCAGGGGACCACCGTGACCGTGTCCAGC |
| SEQ ID NO: 309 (Kabat) | LCDR1 | RASSSVSSMH |
| SEQ ID NO: 310 (Kabat) | LCDR2 | ATSNLAS |
| SEQ ID NO: 311 (Kabat) | LCDR3 | QQWIFNPPT |
| SEQ ID NO: 312 (Chothia) | LCDR1 | SSSVSS |
| SEQ ID NO: 313 (Chothia) | LCDR2 | ATS |
| SEQ ID NO: 314 (Chothia) | LCDR3 | WIFNPP |
| SEQ ID NO: 315 (IMGT) | LCDR1 | SSVSS |
| SEQ ID NO: 316 (IMGT) | LCDR2 | ATS |
| SEQ ID NO: 317 (IMGT) | LCDR3 | QQWIFNPPT |
| SEQ ID NO: 961 (Combined Chothia and Kabat) | LCDR1 | RASSSVSSMH |
| SEQ ID NO: 962 (Combined Chothia and Kabat) | LCDR2 | ATSNLAS |
| SEQ ID NO: 963 (Combined Chothia and Kabat) | LCDR3 | QQWIFNPPT |
| SEQ ID NO: 318 | VL | DIQLTQSPSFLSASVGDRVTITCRASSSVSSMHWYQ QKPGKAPKPLIFATSNLASGVPSRFSGSGSGTEYTL TISSLQPEDFATYYCQQWIFNPPTFGGGTKVEIK |
| SEQ ID NO: 319 | DNA VL | GATATCCAGCTGACCCAGAGCCCTTCCTTCCTGT CCGCTTCCGTGGGAGACAGAGTCACTATTACTTG TCGGGCCTCCTCATCCGTGTCATCCATGCACTGG TACCAGCAGAAGCCGGGAAAGGCCCCAAAGCCC TTGATCTTTGCCACTTCCAACCTGGCATCCGGCG TGCCCTCGAGGTTCTCCGGGAGCGGTTCAGGGAC CGAGTACACTCTGACCATTAGCAGCCTCCAGCCT GAGGACTTTGCCACCTACTACTGCCAGCAGTGGA TTTTCAACCCGCCTACATTCGGAGGGGGCACTAA GGTCGAAATCAAG |

TABLE 1-continued

CD20 CAR Constructs

| SEQ ID NUMBER | Ab region | Sequence |
|---|---|---|
| SEQ ID NO: 320 | Linker | GGGGSGGGGSGGGGSGGGGS |
| SEQ ID NO: 321 | scFv (VH-linker-VL) | QVQLVQSGAEVKKPGSSVKVSCKASGYTFTSYNM HWVRQAPGQGLEWMGAIYPGNGDTSYNPKFKGR VTITADKSTRTAYMELSSLRSEDTAVYYCARSYFY GSSSWYFDVWGQGTTVTVSSGGGGSGGGGSGGG GSGGGGSDIQLTQSPSFLSASVGDRVTITCRASSSVS SMHWYQQKPGKAPKPLIFATSNLASGVPSRFSGSG SGTEYTLTISSLQPEDFATYYCQQWIFNPPTFGGGT KVEIK |
| SEQ ID NO: 322 | DNA scFv (VH-linker-VL) | CAAGTGCAACTCGTCCAGTCCGGTGCAGAAGTCAAG AAGCCAGGTTCCTCGGTGAAAGTGTCCTGCAAAGCCT CGGGTTACACCTTCACCTCGTACAATATGCACTGGGT CCGCCAAGCTCCGGGACAAGGCCTGGAATGGATGGG AGCGATCTACCCCGGAAACGGCGACACGTCCTACAA CCCGAAGTTCAAGGGAAGAGTGACCATCACCGCCGA CAAGTCCACCCGCACCGCGTACATGGAGCTTAGCAG CCTGCGGAGCGAGGACACTGCCGTGTATTACTGCGCC CGGTCCTACTTCTATGGATCATCCTCGTGGTACTTCG ATGTCTGGGGCCAGGGGACCACCGTGACCGTGTCCA GCGGTGGCGGAGGCAGCGGCGGAGGAGGGTCTGGAG GAGGCGGCTCGGGGGGAGGGGGCTCGGATATCCAGC TGACCCAGAGCCCTTCCTTCCTGTCCGCTTCCGTGGG AGACAGAGTCACTATTACTTGTCGGGCCTCCTCATCC GTGTCATCCATGCACTGGTACCAGCAGAAGCCGGGA AAGGCCCCAAAGCCCTTGATCTTTGCCACTTCCAACC TGGCATCCGGCGTGCCCTCGAGGTTCTCCGGGAGCGG TTCAGGGACCGAGTACACTCTGACCATTAGCAGCCTC CAGCCTGAGGACTTTGCCACCTACTACTGCCAGCAGT GGATTTTCAACCCGCCTACATTCGGAGGGGGCACTAA GGTCGAAATCAAG |
| SEQ ID NO: 323 | Full CAR amino acid sequence | MALPVTALLLPLALLLHAARPQVQLVQSGAEVKK PGSSVKVSCKASGYTFTSYNMHWVRQAPGQGLE WMGAIYPGNGDTSYNPKFKGRVTITADKSTRTAY MELSSLRSEDTAVYYCARSYFYGSSSWYFDVWGQ GTTVTVSSGGGGSGGGGSGGGGSGGGGSDIQLTQS PSFLSASVGDRVTITCRASSSVSSMHWYQQKPGKA PKPLIFATSNLASGVPSRFSGSGSGTEYTLTISSLQPE DFATYYCQQWIFNPPTFGGGTKVEIKTTTPAPRPPT PAPTIASQPLSLRPEACRPAAGGAVHTRGLDFACDI YIWAPLAGTCGVLLLSLVITLYCKRGRKKLLYIFKQ PFMRPVQTTQEEDGCSCRFPEEEEGGCELRVKFSRS ADAPAYQQGQNQLYNELNLGRREEYDVLDKRRG RDPEMGGKPRRKNPQEGLYNELQKDKMAEAYSEI GMKGERRRGKGHDGLYQGLSTATKDTYDALHMQ ALPPR |
| SEQ ID NO: 324 | Full CAR nucleic acid sequence | ATGGCCCTCCCTGTCACCGCCCTGCTGCTTCCGC TGGCTCTTCTGCTCCACGCCGCTCGGCCCCAAGT GCAACTCGTCCAGTCCGGTGCAGAAGTCAAGAA GCCAGGTTCCTCGGTGAAAGTGTCCTGCAAAGCC TCGGGTTACACCTTCACCTCGTACAATATGCACT GGGTCCGCCAAGCTCCGGGACAAGGCCTGGAAT GGATGGGAGCGATCTACCCCGGAAACGGCGACA CGTCCTACAACCCGAAGTTCAAGGGAAGAGTGA CCATCACCGCCGACAAGTCCACCCGCACCGCGT ACATGGAGCTTAGCAGCCTGCGGAGCGAGGACA CTGCCGTGTATTACTGCGCCCGGTCCTACTTCTA TGGATCATCCTCGTGGTACTTCGATGTCTGGGGC CAGGGGACCACCGTGACCGTGTCCAGCGGTGGC GGAGGCAGCGGCGGAGGAGGGTCTGGAGGAGG CGGCTCGGGGGGAGGGGGCTCGGATATCCAGCT GACCCAGAGCCCTTCCTTCCTGTCCGCTTCCGTG GGAGACAGAGTCACTATTACTTGTCGGGCCTCCT CATCCGTGTCATCCATGCACTGGTACCAGCAGAA GCCGGGAAAGGCCCCAAAGCCCTTGATCTTTGCC ACTTCCAACCTGGCATCCGGCGTGCCCTCGAGGT TCTCCGGGAGCGGTTCAGGGACCGAGTACACTCT GACCATTAGCAGCCTCCAGCCTGAGGACTTTGCC ACCTACTACTGCCAGCAGTGGATTTTCAACCCGC CTACATTCGGAGGGGGCACTAAGGTCGAAATCA |

TABLE 1-continued

CD20 CAR Constructs

| SEQ ID NUMBER | Ab region | Sequence |
|---|---|---|
| | | AGACCACTACCCCAGCACCGAGGCCACCCACCC CGGCTCCTACCATCGCCTCCCAGCCTCTGTCCCT GCGTCCGGAGGCATGTAGACCCGCAGCTGGTGG GGCCGTGCATACCCGGGGTCTTGACTTCGCCTGC GATATCTACATTTGGGCCCCTCTGGCTGGTACTT GCGGGGTCCTGCTGCTTTCACTCGTGATCACTCT TTACTGTAAGCGCGGTCGGAAGAAGCTGCTGTA CATCTTTAAGCAACCCTTCATGAGGCCTGTGCAG ACTACTCAAGAGGAGGACGGCTGTTCATGCCGG TTCCCAGAGGAGGAGGAAGGCGGCTGCGAACTG CGCGTGAAATTCAGCCGCAGCGCAGATGCTCCA GCCTACCAGCAGGGGCAGAACCAGCTCTACAAC GAACTCAATCTTGGTCGGAGAGAGGAGTACGAC GTGCTGGACAAGCGGAGAGGACGGGACCCAGAA ATGGGCGGGAAGCCGCGCAGAAAGAATCCCCAA GAGGGCCTGTACAACGAGCTCCAAAAGGATAAG ATGGCAGAAGCCTATAGCGAGATTGGTATGAAA GGGGAACGCAGAAGAGGCAAAGGCCACGACGG ACTGTACCAGGGACTCAGCACCGCCACCAAGGA CACCTATGACGCTCTTCACATGCAGGCCCTGCCG CCTCGG |

CD20-C8H1

| SEQ ID NO: 325 (Kabat) | HCDR1 | RYNMH |
|---|---|---|
| SEQ ID NO: 326 (Kabat) | HCDR2 | AIYPGNGDTSYSQKFKG |
| SEQ ID NO: 327 (Kabat) | HCDR3 | SFFYGSSDWYFDV |
| SEQ ID NO: 328 (Chothia) | HCDR1 | GYTFTRY |
| SEQ ID NO: 329 (Chothia) | HCDR2 | YPGNGD |
| SEQ ID NO: 330 (Chothia) | HCDR3 | SFFYGSSDWYFDV |
| SEQ ID NO: 331 (IMGT) | HCDR1 | GYTFTRYN |
| SEQ ID NO: 332 (IMGT) | HCDR2 | IYPGNGDT |
| SEQ ID NO: 333 (IMGT) | HCDR3 | ARSFFYGSSDWYFDV |
| SEQ ID NO: 964 (Combined Chothia and Kabat) | HCDR1 | GYTFTRYNMH |
| SEQ ID NO: 965 (Combined Chothia and Kabat) | HCDR2 | AIYPGNGDTSYSQKFKG |
| SEQ ID NO: 966 (Combined Chothia and Kabat) | HCDR3 | SFFYGSSDWYFDV |
| SEQ ID NO: 334 | VH | QVQLVQSGAEVKKPGASVKVSCKASGYTFTRYNM HWVRQAPGQRLEWMGAIYPGNGDTSYSQKFKGR VTITADKSASTAYMELSSLRSEDTAVYYCARSFFY GSSDWYFDVWGQGTTVTVSS |
| SEQ ID NO: 335 | DNA VH | CAAGTCCAACTCGTCCAGTCAGGAGCAGAAGTC AAGAAACCAGGAGCATCCGTGAAAGTGTCGTGC AAAGCCTCTGGCTACACCTTCACCCGGTACAACA TGCACTGGGTCAGACAGGCCCCGGGACAGCGGC |

TABLE 1-continued

CD20 CAR Constructs

| SEQ ID NUMBER | Ab region | Sequence |
|---|---|---|
| | | TCGAGTGGATGGGTGCCATCTACCCCGGCAACG GGGACACCTCCTACTCCCAAAAGTTCAAGGGTC GCGTGACCATCACGGCGGATAAGTCGGCCAGCA CTGCGTACATGGAATTGTCATCCCTGCGCTCCGA GGATACCGCCGTGTATTACTGCGCGCGGTCCTTC TTCTACGGCTCCTCCGATTGGTACTTCGACGTCT GGGGACAGGGAACTACCGTGACCGTGTCCTCC |
| SEQ ID NO: 336 (Kabat) | LCDR1 | RASSSVNNMH |
| SEQ ID NO: 337 (Kabat) | LCDR2 | ATSNLAS |
| SEQ ID NO: 338 (Kabat) | LCDR3 | QQWIFNPPT |
| SEQ ID NO: 339 (Chothia) | LCDR1 | SSSVNN |
| SEQ ID NO: 340 (Chothia) | LCDR2 | ATS |
| SEQ ID NO: 341 (Chothia) | LCDR3 | WIFNPP |
| SEQ ID NO: 342 (IMGT) | LCDR1 | SSVNN |
| SEQ ID NO: 343 (IMGT) | LCDR2 | ATS |
| SEQ ID NO: 344 (IMGT) | LCDR3 | QQWIFNPPT |
| SEQ ID NO: 967 (Combined Chothia and Kabat) | LCDR1 | RASSSVNNMH |
| SEQ ID NO: 968 (Combined Chothia and Kabat) | LCDR2 | ATSNLAS |
| SEQ ID NO: 969 (Combined Chothia and Kabat) | LCDR3 | QQWIFNPPT |
| SEQ ID NO: 345 | VL | EIVLTQSPDFQSVTPKEKVTITCRASSSVNNMHWY QQKPDQSPKPLIYATSNLASGVPSRFSGSGSGTDYT LTINSLEAEDAATYYCQQWIFNPPTFGQGTKLEIK |
| SEQ ID NO: 346 | DNA VL | GAAATCGTGCTGACTCAGTCGCCGGACTTCCAAA GCGTGACCCCAAAGGAGAAGGTCACCATCACCT GTAGAGCCTCATCGTCCGTGAACAATATGCACTG GTACCAGCAGAAGCCGGACCAGTCCCCTAAGCC CCTGATCTACGCCACTTCCAACCTGGCCTCCGGC GTGCCGTCGAGGTTCAGCGGCTCGGGCAGCGGG ACCGACTACACCCTGACCATCAACAGCCTTGAA GCTGAGGACGCCGCTACCTACTACTGCCAGCAGT GGATTTTCAACCCTCCCACATTTGGACAGGGCAC TAAGCTGGAGATTAAG |
| SEQ ID NO: 347 | Linker | GGGGSGGGGSGGGGSGGGGS |
| SEQ ID NO: 348 | scFv (VH-linker-VL) | QVQLVQSGAEVKKPGASVKVSCKASGYTFTRYNM HWVRQAPGQRLEWMGAIYPGNGDTSYSQKFKGR VTITADKSASTAYMELSSLRSEDTAVYYCARSFFY GSSDWYFDVWGQGTTVTVSSGGGGSGGGGSGGG GSGGGGSEIVLTQSPDFQSVTPKEKVTITCRASSSV NNMHWYQQKPDQSPKPLIYATSNLASGVPSRFSGS |

TABLE 1-continued

CD20 CAR Constructs

| SEQ ID NUMBER | Ab region | Sequence |
|---|---|---|
| | | GSGTDYTLTINSLEAEDAATYYCQQWIFNPPTFGQ GTKLEIK |
| SEQ ID NO: 349 | DNA scFv (VH-linker-VL) | CAAGTCCAACTCGTCCAGTCAGGAGCAGAAGTCAAG AAACCAGGAGCATCCGTGAAAGTGTCGTGCAAAGCC TCTGGCTACACCTTCACCCGGTACAACATGCACTGGG TCAGACAGGCCCCGGGACAGCGGCTCGAGTGGATGG GTGCCATCTACCCCGGCAACGGGACACCTCCTACTC CCAAAAGTTCAAGGGTCGCGTGACCATCACGGCGGA TAAGTCGGCCAGCACTGCGTACATGGAATTGTCATCC CTGCGCTCCGAGGATACCGCCGTGTATTACTGCGCGC GGTCCTTCTTCTACGGCTCCTCCGATTGGTACTTCGAC GTCTGGGGACAGGGAACTACCGTGACCGTGTCCTCCG GGGGTGGCGGGAGCGGAGGGGGCGGAAGCGGGGGT GGAGGATCAGGAGGCGGAGGCTCCGAAATCGTGCTG ACTCAGTCGCCGGACTTCCAAAGCGTGACCCCAAAG GAGAAGGTCACCATCACCTGTAGAGCCTCATCGTCCG TGAACAATATGCACTGGTACCAGCAGAAGCCGGACC AGTCCCCTAAGCCCCTGATCTACGCCACTTCCAACCT GGCCTCCGGCGTGCCGTCGAGGTTCAGCGGCTCGGGC AGCGGGACCGACTACACCCTGACCATCAACAGCCTT GAAGCTGAGGACGCCGCTACCTACTACTGCCAGCAG TGGATTTTCAACCCTCCCACATTTGGACAGGGCACTA AGCTGGAGATTAAG |
| SEQ ID NO: 350 | Full CAR amino acid sequence | MALPVTALLLPLALLLHAARPQVQLVQSGAEVKK PGASVKVSCKASGYTFTRYNMHWVRQAPGQRLE WMGAIYPGNGDTSYSQKFKGRVTITADKSASTAY MELSSLRSEDTAVYYCARSFFYGSSDWYFDVWGQ GTTVTVSSGGGGSGGGGSGGGGSGGGGSEIVLTQS PDFQSVTPKEKVTITCRASSSVNNMHWYQQKPDQS PKPLIYATSNLASGVPSRFSGSGSGTDYTLTINSLEA EDAATYYCQQWIFNPPTFGQGTKLEIKTTTPAPRPP TPAPTIASQPLSLRPEACRPAAGGAVHTRGLDFACD IYIWAPLAGTCGVLLLSLVITLYCKRGRKKLLYIFK QPFMRPVQTTQEEDGCSCRFPEEEEGGCELRVKFS RSADAPAYQQGQNQLYNELNLGRREEYDVLDKRR GRDPEMGGKPRRKNPQEGLYNELQKDKMAEAYS EIGMKGERRRGKGHDGLYQGLSTATKDTYDALH MQALPPR |
| SEQ ID NO: 351 | Full CAR nucleic acid sequence | ATGGCCCTCCCTGTCACCGCCCTGCTGCTTCCGC TGGCTCTTCTGCTCCACGCCGCTCGGCCCCCAAGT CCAACTCGTCCAGTCAGGAGCAGAAGTCAAGAA ACCAGGAGCATCCGTGAAAGTGTCGTGCAAAGC CTCTGGCTACACCTTCACCCGGTACAACATGCAC TGGGTCAGACAGGCCCCGGGACAGCGGCTCGAG TGGATGGGTGCCATCTACCCCGGCAACGGGGAC ACCTCCTACTCCCAAAAGTTCAAGGGTCGCGTGA CCATCACGGCGGATAAGTCGGCCAGCACTGCGT ACATGGAATTGTCATCCCTGCGCTCCGAGGATAC CGCCGTGTATTACTGCGCGCGGTCCTTCTTCTAC GGCTCCTCCGATTGGTACTTCGACGTCTGGGGAC AGGGAACTACCGTGACCGTGTCCTCCGGGGGTG GCGGGAGCGGAGGGGGCGGAAGCGGGGGTGGA GGATCAGGAGGCGGAGGCTCCGAAATCGTGCTG ACTCAGTCGCCGGACTTCCAAAGCGTGACCCCA AAGGAGAAGGTCACCATCACCTGTAGAGCCTCA TCGTCCGTGAACAATATGCACTGGTACCAGCAG AAGCCGGACCAGTCCCCTAAGCCCCTGATCTACG CCACTTCCAACCTGGCCTCCGGCGTGCCGTCGAG GTTCAGCGGCTCGGGCAGCGGGACCGACTACAC CCTGACCATCAACAGCCTTGAAGCTGAGGACGC CGCTACCTACTACTGCCAGCAGTGGATTTTCAAC CCTCCCACATTTGGACAGGGCACTAAGCTGGAG ATTAAGACCACTACCCCAGCACCGAGGCCACCC ACCCCGGCTCCTACCATCGCCTCCCAGCCTCTGT CCCTGCGTCCGGAGGCATGTAGACCCGCAGCTG GTGGGGCCGTGCATACCCGGGGTCTTGACTTCGC CTGCGATATCTACATTTGGGCCCCTCTGGCTGGT ACTTGCGGGGTCCTGCTGCTTTCACTCGTGATCA CTCTTTACTGTAAGCGCGGTCGGAAGAAGCTGCT GTACATCTTTAAGCAACCCTTCATGAGGCCTGTG CAGACTACTCAAGAGGAGGACGGCTGTTCATGC CGGTTCCCAGAGGAGGAGGAAGGCGGCTGCGAA |

TABLE 1-continued

CD20 CAR Constructs

| SEQ ID NUMBER | Ab region | Sequence |
|---|---|---|
| | | CTGCGCGTGAAATTCAGCCGCAGCGCAGATGCT<br>CCAGCCTACCAGCAGGGGCAGAACCAGCTCTAC<br>AACGAACTCAATCTTGGTCGGAGAGAGGAGTAC<br>GACGTGCTGGACAAGCGGAGAGGACGGGACCCA<br>GAAATGGGCGGGAAGCCGCGCAGAAAGAATCCC<br>CAAGAGGGCCTGTACAACGAGCTCCAAAAGGAT<br>AAGATGGCAGAAGCCTATAGCGAGATTGGTATG<br>AAAGGGGAACGCAGAAGAGGCAAAGGCCACGA<br>CGGACTGTACCAGGGACTCAGCACCGCCACCAA<br>GGACACCTATGACGCTCTTCACATGCAGGCCCTG<br>CCGCCTCGG |

CD20-C8H2

| SEQ ID NO: 352 (Kabat) | HCDR1 | RYNMH |
| --- | --- | --- |
| SEQ ID NO: 353 (Kabat) | HCDR2 | AIYPGNGDTSYSQKFKG |
| SEQ ID NO: 354 (Kabat) | HCDR3 | SFFYGSSDWYFDV |
| SEQ ID NO: 355 (Chothia) | HCDR1 | GYTFTRY |
| SEQ ID NO: 356 (Chothia) | HCDR2 | YPGNGD |
| SEQ ID NO: 357 (Chothia) | HCDR3 | SFFYGSSDWYFDV |
| SEQ ID NO: 358 (IMGT) | HCDR1 | GYTFTRYN |
| SEQ ID NO: 359 (IMGT) | HCDR2 | IYPGNGDT |
| SEQ ID NO: 360 (IMGT) | HCDR3 | ARSFFYGSSDWYFDV |
| SEQ ID NO: 970 (Combined Chothia and Kabat) | HCDR1 | GYTFTRYNMH |
| SEQ ID NO: 971 (Combined Chothia and Kabat) | HCDR2 | AIYPGNGDTSYSQKFKG |
| SEQ ID NO: 972 (Combined Chothia and Kabat) | HCDR3 | SFFYGSSDWYFDV |
| SEQ ID NO: 361 | VH | QVQLVQSGAEVKKPGASVKVSCKASGYTFTRYNM<br>HWVRQAPGQRLEWMGAIYPGNGDTSYSQKFKGR<br>VTITADKSASTAYMELSSLRSEDTAVYYCARSFFY<br>GSSDWYFDVWGQGTTVTVSS |
| SEQ ID NO: 362 | DNA VH | CAAGTGCAACTCGTCCAATCCGGCGCGGAAGTC<br>AAAAAGCCTGGAGCCTCCGTCAAAGTGTCCTGC<br>AAGGCCTCCGGTTACACTTTCACTCGCTACAACA<br>TGCATTGGGTGCGGCAGGCCCCGGGACAGCGCC<br>TGGAATGGATGGGCGCAATCTACCCCGGCAACG<br>GAGACACCTCCTATTCCCAAAAGTTCAAGGGAA<br>GGGTCACAATCACGGCCGACAAGAGCGCCTCAA<br>CTGCCTACATGGAGCTGAGCAGCCTCAGATCCG<br>AAGATACCGCGGTGTACTACTGCGCCCGGAGCTT<br>CTTCTACGGTTCGTCTGATTGGTACTTTGACGTCT<br>GGGGCCAGGGAACCACCGTGACCGTGTCGTCC |
| SEQ ID NO: 363 (Kabat) | LCDR1 | RASSSVNNMH |

TABLE 1-continued

CD20 CAR Constructs

| SEQ ID NUMBER | Ab region | Sequence |
|---|---|---|
| SEQ ID NO: 364 (Kabat) | LCDR2 | ATSNLAS |
| SEQ ID NO: 365 (Kabat) | LCDR3 | QQWIFNPPT |
| SEQ ID NO: 366 (Chothia) | LCDR1 | SSSVNN |
| SEQ ID NO: 367 (Chothia) | LCDR2 | ATS |
| SEQ ID NO: 368 (Chothia) | LCDR3 | WIFNPP |
| SEQ ID NO: 369 (IMGT) | LCDR1 | SSVNN |
| SEQ ID NO: 370 (IMGT) | LCDR2 | ATS |
| SEQ ID NO: 371 (IMGT) | LCDR3 | QQWIFNPPT |
| SEQ ID NO: 973 (Combined Chothia and Kabat) | LCDR1 | RASSSVNNMH |
| SEQ ID NO: 974 (Combined Chothia and Kabat) | LCDR2 | ATSNLAS |
| SEQ ID NO: 975 (Combined Chothia and Kabat) | LCDR3 | QQWIFNPPT |
| SEQ ID NO: 372 | VL | DIQLTQSPSFLSASVGDRVTITCRASSSVNNMHWY QQKPGKAPKPLIYATSNLASGVPSRFSGSGSGTEYT LTISSLQPEDFATYYCQQWIFNPPTFGQGTKLEIK |
| SEQ ID NO: 373 | DNA VL | GACATCCAGCTTACCCAGTCGCCATCATTCCTGT CCGCATCAGTGGGTGATCGCGTGACCATTACCTG TCGGGCGTCCTCCTCCGTGAACAACATGCACTGG TACCAGCAGAAGCCGGGGAAGGCTCCCAAGCCT CTGATCTACGCCACTAGCAATTTGGCCAGCGGCG TGCCTTCGAGATTCTCGGGGTCGGGCTCAGGAAC CGAGTATACCCTGACCATTTCCTCCCTCCAACCG GAGGACTTTGCTACTTACTACTGCCAGCAGTGGA TTTTCAACCCCCCGACTTTCGGACAGGGCACCAA GCTGGAAATCAAG |
| SEQ ID NO: 374 | Linker | GGGGSGGGGSGGGGSGGGGS |
| SEQ ID NO: 375 | scFv (VH-linker-VL) | QVQLVQSGAEVKKPGASVKVSCKASGYTFTRYNM HWVRQAPGQRLEWMGAIYPGNGDTSYSQKFKGR VTITADKSASTAYMELSSLRSEDTAVYYCARSFFY GSSDWYFDVWGQGTTVTVSSGGGGSGGGGSGGG GSGGGGSDIQLTQSPSFLSASVGDRVTITCRASSSV NNMHWYQQKPGKAPKPLIYATSNLASGVPSRFSGS GSGTEYTLTISSLQPEDFATYYCQQWIFNPPTFGQG TKLEIK |
| SEQ ID NO: 376 | DNA scFv (VH-linker-VL) | CAAGTGCAACTCGTCCAATCCGGCGCGGAAGTCAAA AAGCCTGGAGCCTCCGTCAAAGTGTCCTGCAAGGCCT CCGGTTACACTTTCACTCGCTACAACATGCATTGGGT GCGGCAGGCCCCGGGACAGCGCCTGGAATGGATGGG CGCAATCTACCCCGGCAACGGAGACACCTCCTATTCC CAAAAGTTCAAGGGAAGGGTCACAATCACGGCCGAC AAGAGCGCCTCAACTGCCTACATGGAGCTGAGCAGC CTCAGATCCGAAGATACCGCGGTGTACTACTGCGCCC |

TABLE 1-continued

CD20 CAR Constructs

| SEQ ID NUMBER | Ab region | Sequence |
|---|---|---|
| | | GGAGCTTCTTCTACGGTTCGTCTGATTGGTACTTTGAC<br>GTCTGGGGCCAGGGAACCACCGTGACCGTGTCGTCC<br>GGTGGCGGAGGGAGCGGTGGAGGAGGCTCCGGGGG<br>AGGAGGCAGCGGCGGGGGAGGCAGCGACATCCAGCT<br>TACCCAGTCGCCATCATTCCTGTCCGCATCAGTGGGT<br>GATCGCGTGACCATTACCTGTCGGGCGTCCTCCTCCG<br>TGAACAACATGCACTGGTACCAGCAGAAGCCGGGGA<br>AGGCTCCCAAGCCTCTGATCTACGCCACTAGCAATTT<br>GGCCAGCGGCGTGCCTTCGAGATTCTCGGGGTCGGGC<br>TCAGGAACCGAGTATACCCTGACCATTTCCTCCCTCC<br>AACCGGAGGACTTTGCTACTTACTACTGCCAGCAGTG<br>GATTTTCAACCCCCCGACTTTCGGACAGGGCACCAAG<br>CTGGAAATCAAG |
| SEQ ID NO: 377 | Full CAR amino acid sequence | MALPVTALLLPLALLLHAARPQVQLVQSGAEVKK<br>PGASVKVSCKASGYTFTRYNMHWVRQAPGQRLE<br>WMGAIYPGNGDTSYSQKFKGRVTITADKSASTAY<br>MELSSLRSEDTAVYYCARSFFYGSSDWYFDVWGQ<br>GTTVTVSSGGGGSGGGGSGGGGSGGGGSDIQLTQS<br>PSFLSASVGDRVTITCRASSSVNNMHWYQQKPGK<br>APKPLIYATSNLASGVPSRFSGSGSGTEYTLTISSLQ<br>PEDFATYYCQQWIFNPPTFGQGTKLEIKTTTPAPRP<br>PTPAPTIASQPLSLRPEACRPAAGGAVHTRGLDFAC<br>DIYIWAPLAGTCGVLLLSLVITLYCKRGRKKLLYIF<br>KQPFMRPVQTTQEEDGCSCRFPEEEEGGCELRVKF<br>SRSADAPAYQQGQNQLYNELNLGRREEYDVLDKR<br>RGRDPEMGGKPRRKNPQEGLYNELQKDKMAEAY<br>SEIGMKGERRRGKGHDGLYQGLSTATKDTYDALH<br>MQALPPR |
| SEQ ID NO: 378 | Full CAR nucleic acid sequence | ATGGCCCTCCCTGTCACCGCCCTGCTGCTTCCGC<br>TGGCTCTTCTGCTCCACGCCGCTCGGCCCCAAGT<br>GCAACTCGTCCAATCCGGCGCGGAAGTCAAAAA<br>GCCTGGAGCCTCCGTCAAAGTGTCCTGCAAGGCC<br>TCCGGTTACACTTTCACTCGCTACAACATGCATT<br>GGGTGCGGCAGGCCCCGGGACAGCGCCTGGAAT<br>GGATGGGCGCAATCTACCCCGGCAACGGAGACA<br>CCTCCTATTCCCAAAAGTTCAAGGGAAGGGTCAC<br>AATCACGGCCGACAAGAGCGCCTCAACTGCCTA<br>CATGGAGCTGAGCAGCCTCAGATCCGAAGATAC<br>CGCGGTGTACTACTGCGCCCGGAGCTTCTTCTAC<br>GGTTCGTCTGATTGGTACTTTGACGTCTGGGGCC<br>AGGGAACCACCGTGACCGTGTCGTCCGGTGGCG<br>GAGGGAGCGGTGGAGGAGGCTCCGGGGGAGGA<br>GGCAGCGGCGGGGGAGGCAGCGACATCCAGCTT<br>ACCCAGTCGCCATCATTCCTGTCCGCATCAGTGG<br>GTGATCGCGTGACCATTACCTGTCGGGCGTCCTC<br>CTCCGTGAACAACATGCACTGGTACCAGCAGAA<br>GCCGGGGAAGGCTCCCAAGCCTCTGATCTACGC<br>CACTAGCAATTTGGCCAGCGGCGTGCCTTCGAGA<br>TTCTCGGGGTCGGGCTCAGGAACCGAGTATACCC<br>TGACCATTTCCTCCCTCCAACCGGAGGACTTTGC<br>TACTTACTACTGCCAGCAGTGGATTTTCAACCCC<br>CCGACTTTCGGACAGGGCACCAAGCTGGAAATC<br>AAGACCACTACCCCAGCACCGAGGCCACCCACC<br>CCGGCTCCTACCATCGCCTCCCAGCCTCTGTCCC<br>TGCGTCCGGAGGCATGTAGACCCGCAGCTGGTG<br>GGGCCGTGCATACCCGGGGTCTTGACTTCGCCTG<br>CGATATCTACATTTGGGCCCCTCTGGCTGGTACT<br>TGCGGGGTCCTGCTGCTTTCACTCGTGATCACTC<br>TTTACTGTAAGCGCGGTCGGAAGAAGCTGCTGTA<br>CATCTTTAAGCAACCCTTCATGAGGCCTGTGCAG<br>ACTACTCAAGAGGAGGACGGCTGTTCATGCCGG<br>TTCCCAGAGGAGGAGGAAGGCGGCTGCGAACTG<br>CGCGTGAAATTCAGCCGCAGCGCAGATGCTCCA<br>GCCTACCAGCAGGGGCAGAACCAGCTCTACAAC<br>GAACTCAATCTTGGTCGGAGAGAGGAGTACGAC<br>GTGCTGGACAAGCGGAGAGGACGGGACCCAGAA<br>ATGGGCGGGAAGCCGCGCAGAAAGAATCCCCAA<br>GAGGGCCTGTACAACGAGCTCCAAAAGGATAAG<br>ATGGCAGAAGCCTATAGCGAGATTGGTATGAAA<br>GGGGAACGCAGAAGAGGCAAAGGCCACGACGG<br>ACTGTACCAGGGACTCAGCACCGCCACCAAGGA<br>CACCTATGACGCTCTTCACATGCAGGCCCTGCCG<br>CCTCGG |

TABLE 1-continued

CD20 CAR Constructs

| SEQ ID NUMBER | Ab region | Sequence |
|---|---|---|
| CD20-C8H3 | | |
| SEQ ID NO: 379 (Kabat) | HCDR1 | RYNMH |
| SEQ ID NO: 380 (Kabat) | HCDR2 | AIYPGNGDTSYSQKFKG |
| SEQ ID NO: 381 (Kabat) | HCDR3 | SFFYGSSDWYFDV |
| SEQ ID NO: 382 (Chothia) | HCDR1 | GYTFTRY |
| SEQ ID NO: 383 (Chothia) | HCDR2 | YPGNGD |
| SEQ ID NO: 384 (Chothia) | HCDR3 | SFFYGSSDWYFDV |
| SEQ ID NO: 385 (IMGT) | HCDR1 | GYTFTRYN |
| SEQ ID NO: 386 (IMGT) | HCDR2 | IYPGNGDT |
| SEQ ID NO: 387 (IMGT) | HCDR3 | ARSFFYGSSDWYFDV |
| SEQ ID NO: 976 (Combined Chothia and Kabat) | HCDR1 | GYTFTRYNMH |
| SEQ ID NO: 977 (Combined Chothia and Kabat) | HCDR2 | AIYPGNGDTSYSQKFKG |
| SEQ ID NO: 978 (Combined Chothia and Kabat) | HCDR3 | SFFYGSSDWYFDV |
| SEQ ID NO: 388 | VH | QVQLVQSGAEVKKPGSSVKVSCKASGYTFTRYNM HWVRQAPGQGLEWMGAIYPGNGDTSYSQKFKGR VTITADKSTSTAYMELSSLRSEDTAVYYCARSFFY GSSDWYFDVWGQGTTVTVSS |
| SEQ ID NO: 389 | DNA VH | CAAGTGCAACTCGTCCAGTCCGGTGCAGAAGTC AAGAAGCCTGGTTCCTCCGTGAAAGTGTCCTGCA AAGCGTCTGGCTACACCTTCACCCGGTACAATAT GCACTGGGTCAGACAGGCGCCCGGACAGGGCCT GGAGTGGATGGGGGCCATCTACCCTGGGAACGG CGACACTAGCTACTCCCAAAAGTTCAAGGGCCG CGTGACGATTACCGCCGACAAGTCAACCAGCAC TGCCTATATGGAGCTGAGCTCGCTTCGGAGCGAA GATACCGCCGTGTACTACTGCGCTCGGAGCTTCT TCTACGGGTCCTCGGATTGGTACTTCGACGTCTG GGGCCAGGGGACTACTGTGACCGTGTCCTCC |
| SEQ ID NO: 390 (Kabat) | LCDR1 | RASSSVNNMH |
| SEQ ID NO: 391 (Kabat) | LCDR2 | ATSNLAS |
| SEQ ID NO: 392 (Kabat) | LCDR3 | QQWIFNPPT |
| SEQ ID NO: 393 (Chothia) | LCDR1 | SSSVNN |

TABLE 1-continued

CD20 CAR Constructs

| SEQ ID NUMBER | Ab region | Sequence |
| --- | --- | --- |
| SEQ ID NO: 394 (Chothia) | LCDR2 | ATS |
| SEQ ID NO: 395 (Chothia) | LCDR3 | WIFNPP |
| SEQ ID NO: 396 (IMGT) | LCDR1 | SSVNN |
| SEQ ID NO: 397 (IMGT) | LCDR2 | ATS |
| SEQ ID NO: 398 (IMGT) | LCDR3 | QQWIFNPPT |
| SEQ ID NO: 979 (Combined Chothia and Kabat) | LCDR1 | RASSSVNNMH |
| SEQ ID NO: 980 (Combined Chothia and Kabat) | LCDR2 | ATSNLAS |
| SEQ ID NO: 981 (Combined Chothia and Kabat) | LCDR3 | QQWIFNPPT |
| SEQ ID NO: 399 | VL | EIVLTQSPDFQSVTPKEKVTITCRASSSVNNMHWY QQKPDQSPKPLIYATSNLASGVPSRFSGSGSGTDYT LTINSLEAEDAATYYCQQWIFNPPTFGQGTKLEIK |
| SEQ ID NO: 400 | DNA VL | GAAATCGTGCTGACCCAGTCCCCGGACTTTCAGT CAGTGACTCCCAAGGAGAAGGTCACCATTACTT GTCGCGCCTCCTCCTCGGTGAACAACATGCACTG GTACCAGCAGAAGCCGGACCAGTCCCCGAAGCC CCTGATCTATGCTACCTCCAACTTGGCGTCCGGC GTGCCGTCAAGGTTCAGCGGATCGGGTTCCGGG ACAGACTACACCCTGACTATTAACTCACTCGAGG CCGAGGATGCCGCCACCTACTACTGCCAGCAGT GGATCTTCAACCCTCCAACCTTCGGACAAGGAAC CAAGCTGGAAATCAAG |
| SEQ ID NO: 401 | Linker | GGGGSGGGGSGGGGSGGGGS |
| SEQ ID NO: 402 | scFv (VH-linker-VL) | QVQLVQSGAEVKKPGSSVKVSCKASGYTFTRYNM HWVRQAPGQGLEWMGAIYPGNGDTSYSQKFKGR VTITADKSTSTAYMELSSLRSEDTAVYYCARSFFY GSSDWYFDVWGQGTTVTVSSGGGGSGGGGSGGG GSGGGGSEIVLTQSPDFQSVTPKEKVTITCRASSSV NNMHWYQQKPDQSPKPLIYATSNLASGVPSRFSGS GSGTDYTLTINSLEAEDAATYYCQQWIFNPPTFGQ GTKLEIK |
| SEQ ID NO: 403 | DNA scFv (VH-linker-VL) | CAAGTGCAACTCGTCCAGTCCGGTGCAGAAGTCAAG AAGCCTGGTTCCTCCGTGAAAGTGTCCTGCAAAGCGT CTGGCTACACCTTCACCCGGTACAATATGCACTGGGT CAGACAGGCGCCCGGACAGGGCCTGGAGTGGATGGG GGCCATCTACCCTGGGAACGGCGACACTAGCTACTCC CAAAAGTTCAAGGGCCGCGTGACGATTACCGCCGAC AAGTCAACCAGCACTGCCTATATGGAGCTGAGCTCGC TTCGGAGCGAAGATACCGCCGTGTACTACTGCGCTCG GAGCTTCTTCTACGGGTCCTCGGATTGGTACTTCGAC GTCTGGGGCCAGGGGACTACTGTGACCGTGTCCTCCG GGGGAGGAGGATCGGGCGGAGGCGGTTCGGGAGGC GGCGGAAGCGGAGGCGGAGGTTCAGAAATCGTGCTG ACCCAGTCCCCGGACTTTCAGTCAGTGACTCCCAAGG AGAAGGTCACCATTACTTGTCGCGCCTCCTCCTCGGT GAACAACATGCACTGGTACCAGCAGAAGCCGGACCA GTCCCCGAAGCCCCTGATCTATGCTACCTCCAACTTG GCGTCCGGCGTGCCGTCAAGGTTCAGCGGATCGGGTT |

TABLE 1-continued

CD20 CAR Constructs

| SEQ ID NUMBER | Ab region | Sequence |
|---|---|---|
| | | CCGGGACAGACTACACCCTGACTATTAACTCACTCGA<br>GGCCGAGGATGCCGCCACCTACTACTGCCAGCAGTG<br>GATCTTCAACCCTCCAACCTTCGGACAAGGAACCAAG<br>CTGGAAATCAAG |
| SEQ ID NO: 404 | Full CAR amino acid sequence | MALPVTALLLPLALLLHAARPQVQLVQSGAEVKK<br>PGSSVKVSCKASGYTFTRYNMHWVRQAPGQGLE<br>WMGAIYPGNGDTSYSQKFKGRVTITADKSTSTAY<br>MELSSLRSEDTAVYYCARSFFYGSSDWYFDVWGQ<br>GTTVTVSSGGGGSGGGGSGGGGSGGGGSEIVLTQS<br>PDFQSVTPKEKVTITCRASSSVNNMHWYQQKPDQS<br>PKPLIYATSNLASGVPSRFSGSGSGTDYTLTINSLEA<br>EDAATYYCQQWIFNPPTFGQGTKLEIKTTTPAPRPP<br>TPAPTIASQPLSLRPEACRPAAGGAVHTRGLDFACD<br>IYIWAPLAGTCGVLLLSLVITLYCKRGRKKLLYIFK<br>QPFMRPVQTTQEEDGCSCRFPEEEEGGCELRVKFS<br>RSADAPAYQQGQNQLYNELNLGRREEYDVLDKRR<br>GRDPEMGGKPRRKNPQEGLYNELQKDKMAEAYS<br>EIGMKGERRRGKGHDGLYQGLSTATKDTYDALH<br>MQALPPR |
| SEQ ID NO: 405 | Full CAR nucleic acid sequence | ATGGCCCTCCCTGTCACCGCCCTGCTGCTTCCGC<br>TGGCTCTTCTGCTCCACGCCGCTCGGCCCCAAGT<br>GCAACTCGTCCAGTCCGGTGCAGAAGTCAAGAA<br>GCCTGGTTCCTCCGTGAAAGTGTCCTGCAAAGCG<br>TCTGGCTACACCTTCACCCGGTACAATATGCACT<br>GGGTCAGACAGGCGCCCGGACAGGGCCTGGAGT<br>GGATGGGGGCCATCTACCCTGGGAACGGCGACA<br>CTAGCTACTCCCAAAAGTTCAAGGGCCGCGTGA<br>CGATTACCGCCGACAAGTCAACCAGCACTGCCT<br>ATATGGAGCTGAGCTCGCTTCGGAGCGAAGATA<br>CCGCCGTGTACTACTGCGCTCGGAGCTTCTTCTA<br>CGGGTCCTCGGATTGGTACTTCGACGTCTGGGGC<br>CAGGGGACTACTGTGACCGTGTCCTCCGGGGGA<br>GGAGGATCGGGCGGAGGCGGTTCGGGAGGCGGC<br>GGAAGCGGAGGCGGAGGTTCAGAAATCGTGCTG<br>ACCCAGTCCCCGGACTTTCAGTCAGTGACTCCCA<br>AGGAGAAGGTCACCATTACTTGTCGCGCCTCCTC<br>CTCGGTGAACAACATGCACTGGTACCAGCAGAA<br>GCCGGACCAGTCCCCGAAGCCCCTGATCTATGCT<br>ACCTCCAACTTGGCGTCCGGCGTGCCGTCAAGGT<br>TCAGCGGATCGGGTTCCGGGACAGACTACACCC<br>TGACTATTAACTCACTCGAGGCCGAGGATGCCGC<br>CACCTACTACTGCCAGCAGTGGATCTTCAACCCT<br>CCAACCTTCGGACAAGGAACCAAGCTGGAAATC<br>AAGACCACTACCCCAGCACCGAGGCCACCCACC<br>CCGGCTCCTACCATCGCCTCCCAGCCTCTGTCCC<br>TGCGTCCGGAGGCATGTAGACCCGCAGCTGGTG<br>GGGCCGTGCATACCCGGGGTCTTGACTTCGCCTG<br>CGATATCTACATTTGGGCCCCTCTGGCTGGTACT<br>TGCGGGGTCCTGCTGCTTTCACTCGTGATCACTC<br>TTTACTGTAAGCGCGGTCGGAAGAAGCTGCTGTA<br>CATCTTTAAGCAACCCTTCATGAGGCCTGTGCAG<br>ACTACTCAAGAGGAGGACGGCTGTTCATGCCGG<br>TTCCCAGAGGAGGAGGAAGGCGGCTGCGAACTG<br>CGCGTGAAATTCAGCCGCAGCGCAGATGCTCCA<br>GCCTACCAGCAGGGGCAGAACCAGCTCTACAAC<br>GAACTCAATCTTGGTCGGAGAGAGGAGTACGAC<br>GTGCTGGACAAGCGGAGAGGACGGGACCCAGAA<br>ATGGGCGGAAGCCGCGCAGAAAGAATCCCCAA<br>GAGGGCCTGTACAACGAGCTCCAAAAGGATAAG<br>ATGGCAGAAGCCTATAGCGAGATTGGTATGAAA<br>GGGGAACGCAGAAGAGGCAAAGGCCACGACGG<br>ACTGTACCAGGGACTCAGCACCGCCACCAAGGA<br>CACCTATGACGCTCTTCACATGCAGGCCCTGCCG<br>CCTCGG |

CD20-C8H4

| SEQ ID NO: 406 (Kabat) | HCDR1 | RYNMH |
|---|---|---|
| SEQ ID NO: 407 (Kabat) | HCDR2 | AIYPGNGDTSYSQKFKG |

TABLE 1-continued

CD20 CAR Constructs

| SEQ ID NUMBER | Ab region | Sequence |
|---|---|---|
| SEQ ID NO: 408 (Kabat) | HCDR3 | SFFYGSSDWYFDV |
| SEQ ID NO: 409 (Chothia) | HCDR1 | GYTFTRY |
| SEQ ID NO: 410 (Chothia) | HCDR2 | YPGNGD |
| SEQ ID NO: 411 (Chothia) | HCDR3 | SFFYGSSDWYFDV |
| SEQ ID NO: 412 (IMGT) | HCDR1 | GYTFTRYN |
| SEQ ID NO: 413 (IMGT) | HCDR2 | IYPGNGDT |
| SEQ ID NO: 414 (IMGT) | HCDR3 | ARSFFYGSSDWYFDV |
| SEQ ID NO: 982 (Combined Chothia and Kabat) | HCDR1 | GYTFTRYNMH |
| SEQ ID NO: 983 (Combined Chothia and Kabat) | HCDR2 | AIYPGNGDTSYSQKFKG |
| SEQ ID NO: 984 (Combined Chothia and Kabat) | HCDR3 | SFFYGSSDWYFDV |
| SEQ ID NO: 415 | VH | QVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSS |
| SEQ ID NO: 416 | DNA VH | CAAGTCCAACTCGTCCAGTCTGGCGCAGAAGTCAAGAAGCCCGGAAGCTCCGTGAAAGTGTCCTGCAAAGCGTCGGGTTACACTTTCACCCGGTACAACATGCACTGGGTCAGACAGGCCCCTGGACAAGGACTGGAGTGGATGGGTGCCATCTACCCTGGAAACGGAGATACCTCCTACTCCCAAAAGTTCAAGGGGAGAGTGACCATTACCGCCGACAAGTCAACTTCCACCGCTTACATGGAGCTCAGCTCCCTGCGGTCCGAAGATACTGCGGTGTACTATTGCGCTCGCTCATTTTTCTACGGCTCATCGGATTGGTACTTCGACGTCTGGGGACAGGGAACTACCGTGACCGTGTCCTCG |
| SEQ ID NO: 417 (Kabat) | LCDR1 | RASSSVNNMH |
| SEQ ID NO: 418 (Kabat) | LCDR2 | ATSNLAS |
| SEQ ID NO: 419 (Kabat) | LCDR3 | QQWIFNPPT |
| SEQ ID NO: 420 (Chothia) | LCDR1 | SSSVNN |
| SEQ ID NO: 421 (Chothia) | LCDR2 | ATS |
| SEQ ID NO: 422 (Chothia) | LCDR3 | WIFNPP |
| SEQ ID NO: 423 (IMGT) | LCDR1 | SSVNN |

TABLE 1-continued

CD20 CAR Constructs

| SEQ ID NUMBER | Ab region | Sequence |
|---|---|---|
| SEQ ID NO: 424 (IMGT) | LCDR2 | ATS |
| SEQ ID NO: 425 (IMGT) | LCDR3 | QQWIFNPPT |
| SEQ ID NO: 985 (Combined Chothia and Kabat) | LCDR1 | RASSSVNNMH |
| SEQ ID NO: 986 (Combined Chothia and Kabat) | LCDR2 | ATSNLAS |
| SEQ ID NO: 987 (Combined Chothia and Kabat) | LCDR3 | QQWIFNPPT |
| SEQ ID NO: 426 | VL | DIQLTQSPSFLSASVGDRVTITCRASSSVNNMHWY QQKPGKAPKPLIYATSNLASGVPSRFSGSGSGTEYT LTISSLQPEDFATYYCQQWIFNPPTFGQGTKLEIK |
| SEQ ID NO: 427 | DNA VL | GACATCCAGCTGACTCAGTCCCCGTCCTTCCTGT CCGCCTCCGTGGGGACCGCGTGACGATTACTTG TCGGGCCTCCTCATCCGTGAACAACATGCATTGG TACCAGCAGAAGCCAGGAAAGGCACCGAAGCCG CTTATCTATGCCACCTCGAATCTGGCCAGCGGAG TGCCTTCGAGGTTTAGCGGCTCCGGCTCCGGCAC CGAGTACACTTTGACCATTAGCAGCCTCCAGCCG GAGGACTTCGCCACATACTACTGCCAGCAGTGG ATCTTCAACCCCCCCACCTTCGGCCAAGGAACCA AGCTGGAAATCAAG |
| SEQ ID NO: 428 | Linker | GGGGSGGGGSGGGGSGGGGS |
| SEQ ID NO: 429 | scFv (VH-linker-VL) | QVQLVQSGAEVKKPGSSVKVSCKASGYTFTRYNM HWVRQAPGQGLEWMGAIYPGNGDTSYSQKFKGR VTITADKSTSTAYMELSSLRSEDTAVYYCARSFFY GSSDWYFDVWGQGTTVTVSSGGGGSGGGGSGGG GSGGGGSDIQLTQSPSFLSASVGDRVTITCRASSSV NNMHWYQQKPGKAPKPLIYATSNLASGVPSRFSGS GSGTEYTLTISSLQPEDFATYYCQQWIFNPPTFGQG TKLEIK |
| SEQ ID NO: 430 | DNA scFv (VH-linker-VL) | CAAGTCCAACTCGTCCAGTCTGGCGCAGAAGTC AAGAAGCCCGGAAGCTCCGTGAAAGTGTCCTGC AAAGCGTCGGGTTACACTTTCACCCGGTACAACA TGCACTGGGTCAGACAGGCCCCTGGACAAGGAC TGGAGTGGATGGGTGCCATCTACCCTGGAAACG GAGATACCTCCTACTCCCAAAAGTTCAAGGGGA GAGTGACCATTACCGCCGACAAGTCAACTTCCAC CGCTTACATGGAGCTCAGCTCCCTGCGGTCCGAA GATACTGCGGTGTACTATTGCGCTCGCTCATTTT TCTACGGCTCATCGGATTGGTACTTCGACGTCTG GGGACAGGGAACTACCGTGACCGTGTCCTCGGG GGGAGGAGGATCGGGCGGAGGCGGTTCGGGAGGCG GCGGAAGCGGAGGCGGAGGTTCAGACATCCAGCTG ACTCAGTCCCCGTCCTTCCTGTCCGCCTCCGTGG GGACCGCGTGACGATTACTTGTCGGGCCTCCTC ATCCGTGAACAACATGCATTGGTACCAGCAGAA GCCAGGAAAGGCACCGAAGCCGCTTATCTATGC CACCTCGAATCTGGCCAGCGGAGTGCCTTCGAG GTTTAGCGGCTCCGGCTCCGGCACCGAGTACACT TTGACCATTAGCAGCCTCCAGCCGGAGGACTTCG CCACATACTACTGCCAGCAGTGGATCTTCAACCC CCCCACCTTCGGCCAAGGAACCAAGCTGGAAAT CAAG |

TABLE 1-continued

CD20 CAR Constructs

| SEQ ID NUMBER | Ab region | Sequence |
| --- | --- | --- |
| SEQ ID NO: 431 | Full CAR amino acid sequence | MALPVTALLLPLALLLHAARPQVQLVQSGAEVKK PGSSVKVSCKASGYTFTRYNMHWVRQAPGQGLE WMGAIYPGNGDTSYSQKFKGRVTITADKSTSTAY MELSSLRSEDTAVYYCARSFFYGSSDWYFDVWGQ GTTVTVSSGGGGSGGGGSGGGGSGGGGSDIQLTQS PSFLSASVGDRVTITCRASSSVNNMHWYQQKPGK APKPLIYATSNLASGVPSRFSGSGSGTEYTLTISSLQ PEDFATYYCQQWIFNPPTFGQGTKLEIKTTTPAPRP PTPAPTIASQPLSLRPEACRPAAGGAVHTRGLDFAC DIYIWAPLAGTCGVLLLSLVITLYCKRGRKKLLYIF KQPFMRPVQTTQEEDGCSCRFPEEEEGGCELRVKF SRSADAPAYQQGQNQLYNELNLGRREEYDVLDKR RGRDPEMGGKPRRKNPQEGLYNELQKDKMAEAY SEIGMKGERRRGKGHDGLYQGLSTATKDTYDALH MQALPPR |
| SEQ ID NO: 432 | Full CAR nucleic acid sequence | ATGGCCCTCCCTGTCACCGCCCTGCTGCTTCCGC TGGCTCTTCTGCTCCACGCCGCTCGGCCCCAAGT CCAACTCGTCCAGTCTGGCGCAGAAGTCAAGAA GCCCGGAAGCTCCGTGAAAGTGTCCTGCAAAGC GTCGGGTTACACTTTCACCCGGTACAACATGCAC TGGGTCAGACAGGCCCCTGGACAAGGACTGGAG TGGATGGGTGCCATCTACCCTGGAAACGGAGAT ACCTCCTACTCCCAAAAGTTCAAGGGGAGAGTG ACCATTACCGCCGACAAGTCAACTTCCACCGCTT ACATGGAGCTCAGCTCCCTGCGGTCCGAAGATA CTGCGGTGTACTATTGCGCTCGCTCATTTTTCTAC GGCTCATCGGATTGGTACTTCGACGTCTGGGGAC AGGGAACTACCGTGACCGTGTCCTCGGGGGGAG GGGGGAGCGGCGGAGGGGGCTCGGGCGGTGGA GGAAGCGGAGGCGGCGGTTCGGACATCCAGCTG ACTCAGTCCCCGTCCTTCCTGTCCGCCTCCGTGG GGGACCGCGTGACGATTACTTGTCGGGCCTCCTC ATCCGTGAACAACATGCATTGGTACCAGCAGAA GCCAGGAAAGGCACCGAAGCCGCTTATCTATGC CACCTCGAATCTGGCCAGCGGAGTGCCTTCGAG GTTTAGCGGCTCCGGCTCCGGCACCGAGTACACT TTGACCATTAGCAGCCTCCAGCCGGAGGACTTCG CCACATACTACTGCCAGCAGTGGATCTTCAACCC CCCCACCTTCGGCCAAGGAACCAAGCTGGAAAT CAAGACCACTACCCCAGCACCGAGGCCACCCAC CCCGGCTCCTACCATCGCCTCCCAGCCTCTGTCC CTGCGTCCGGAGGCATGTAGACCCGCAGCTGGT GGGGCCGTGCATACCCGGGGTCTTGACTTCGCCT GCGATATCTACATTTGGGCCCCTCTGGCTGGTAC TTGCGGGGTCCTGCTGCTTTTCACTCGTGATCACT CTTTACTGTAAGCGCGGTCGGAAGAAGCTGCTGT ACATCTTTAAGCAACCCTTCATGAGGCCTGTGCA GACTACTCAAGAGGAGGACGGCTGTTCATGCCG GTTCCCAGAGGAGGAGGAAGGCGGCTGCGAACT GCGCGTGAAATTCAGCCGCAGCGCAGATGCTCC AGCCTACCAGCAGGGGCAGAACCAGCTCTACAA CGAACTCAATCTTGGTCGGAGAGAGGAGTACGA CGTGCTGGACAAGCGGAGAGGACGGGACCCAGA AATGGGCGGGAAGCCGCGCAGAAAGAATCCCCA AGAGGGCCTGTACAACGAGCTCCAAAAGGATAA GATGGCAGAAGCCTATAGCGAGATTGGTATGAA AGGGGAACGCAGAAGAGGCAAAGGCCACGACG GACTGTACCAGGGACTCAGCACCGCCACCAAGG ACACCTATGACGCTCTTCACATGCAGGCCCTGCC GCCTCGG |

CD20-C2

| SEQ ID NO: 433 | VH | QVHLQQSGAELAKPGASVKMSCKASGYTFTNYW MHWVKQRPGQGLEWIGFITPTTGYPEYNQKFKDK ATLTADKSSSTAYMQLSSLTSEDSAVYYCARRKVG KGVYYALDYWGQGTSVTVSS |
| SEQ ID NO: 434 | DNA VH | CAAGTGCATCTGCAGCAGTCGGGGGCCGAACTG GCAAAGCCAGGCGCCAGCGTGAAGATGAGCTGC AAGGCCTCCGGGTACACCTTCACCAACTACTGGA TGCACTGGGTCAAGCAGCGCCCGGGCCAGGGAC TCGAGTGGATCGGGTTCATCACGCCGACTACCGG |

TABLE 1-continued

CD20 CAR Constructs

| SEQ ID NUMBER | Ab region | Sequence |
|---|---|---|
| | | CTACCCGGAGTATAACCAGAAGTTCAAGGACAA<br>GGCCACTCTGACTGCCGACAAGTCCTCGTCTACC<br>GCGTACATGCAACTGTCCTCACTGACTTCGGAGG<br>ATTCCGCTGTGTACTACTGCGCGCGGAGGAAAGT<br>CGGAAAGGGAGTGTACATGCCCTGGACTACTG<br>GGGCCAGGGTACCAGCGTCACTGTGTCCTCC |
| SEQ ID NO: 435 | VL | DILMTQSPASLSASVGETVTITCRASGNIHNYLAWY<br>QQKQGNSPQLLVYNTKTLADGVPSRFSGSGSGTQY<br>SLKINSLQTEDFGTYYCQHFWSSPWTFGGGTKLEIK |
| SEQ ID NO: 436 | DNA VL | GACATTCTGATGACCCAGTCCCCTGCATCACTCT<br>CCGCGTCCGTGGGAGAAACCGTGACCATCACGT<br>GTAGAGCCTCCGGCAACATCCACAACTACCTGG<br>CCTGGTACCAGCAGAAGCAGGGAAACTCGCCCC<br>AACTGCTTGTGTACAACACCAAGACCTTGGCTGA<br>CGGAGTGCCTTCCCGGTTCTCGGGTTCGGGATCA<br>GGCACACAGTACTCCCTGAAAATCAATAGCCTCC<br>AGACCGAAGATTTTGGAACCTACTACTGCCAAC<br>ACTTCTGGAGCTCCCCCTGGACTTTCGGAGGCGG<br>TACCAAGCTCGAGATTAAG |

CD20-C3

| SEQ ID NO: 437 | VH | QVQLQQPGAELVKPGASVKMSCKASGYTFTNYNL<br>HWVKQTPGQGLEWIGAIYPGNYDTSYNQKFKGKA<br>TLTADKSSSTAYMLLSSLTSEDSAVYFCARVDFGH<br>SRYWYFDVWGAGTTVTVSS |
|---|---|---|
| SEQ ID NO: 438 | DNA VH | CAAGTGCAGCTGCAGCAGCCTGGTGCCGAGCTC<br>GTGAAGCCGGGAGCGTCCGTGAAGATGAGCTGC<br>AAAGCCTCGGGCTACACCTTCACCAATTACAACT<br>TGCATTGGGTCAAGCAGACCCCGGGCCAGGGC<br>TCGAATGGATCGGAGCGATCTACCCCGGGAACT<br>ACGATACTAGCTACAACCAGAAGTTCAAGGGAA<br>AGGCCACCCTGACCGCCGATAAGTCCTCATCCAC<br>CGCCTACATGCTGCTGTCCTCGCTGACTTCCGAG<br>GACTCCGCTGTGTACTTCTGCGCCCGCGTGGACT<br>TCGGACACAGCAGATATTGGTATTTTGACGTCTG<br>GGGCGCCGGGACTACCGTGACTGTGTCGTCC |
| SEQ ID NO: 439 | VL | QIVLSQSPAILSASPGEKVTMTCRATSSVSSMNWY<br>QQKPGSFPRPWIHATSNLASGVPARFSGSGSGTSYS<br>LTISRVEAEDAATYYCQQWTFNPPTFGAGAKLELK |
| SEQ ID NO: 440 | DNA VL | CAAATTGTCCTGAGCCAGAGCCCGGCTATCCTGT<br>CCGCCTCACCGGGCGAAAAGGTCACCATGACTT<br>GTCGGGCCACTTCCTCCGTGTCATCCATGAACTG<br>GTACCAGCAGAAGCCTGGCAGCTTCCCTCGGCC<br>ATGGATTCACGCCACGTCAAACCTGGCATCGGG<br>AGTGCCCGCAAGGTTCTCCGGGTCCGGCAGCGG<br>AACATCCTACTCCCTCACCATCTCGCGCGTGGAA<br>GCGGAGGACGCTGCCACCTACTACTGCCAACAG<br>TGGACCTTCAACCCCCCCACCTTTGGAGCGGGAG<br>CCAAGCTGGAACTTAAG |

CD20-C5

| SEQ ID NO: 441 | VH | QVQLQQPGAELVKPGASVKMSCKASGYTFTSYNM<br>HWVKQTPGQGLEWIGAIYPGNGDTSYNPKFKGKA<br>TLTADKSSRTAYIHLSSLTSEDSVVYYCARSYFYGS<br>SSWYFDVWGAGTTVTVSS |
|---|---|---|
| SEQ ID NO: 442 | DNA VH | CAAGTGCAGCTGCAGCAGCCGGGAGCAGAGCTC<br>GTGAAGCCTGGAGCCTCAGTGAAGATGAGCTGC<br>AAGGCCTCCGGTTACACCTTCACCTCCTACAACA<br>TGCACTGGGTCAAGCAGACCCCCGGACAAGGCC<br>TGGAATGGATCGGCGCCATCTACCCGGGAAACG<br>GGGACACCTCCTATAACCCCAAGTTCAAGGGAA<br>AAGCAACCCTGACCGCGGACAAGTCCAGCAGAA<br>CTGCCTACATCCATCTTTCCTCGCTGACGTCCGA<br>GGATTCCGTGGTGTACTACTGTGCCCGCTCCTAC<br>TTCTACGGGTCATCCTCGTGGTACTTCGATGTCT<br>GGGGCGCTGGAACCACCGTGACTGTGTCCTCC |

TABLE 1-continued

CD20 CAR Constructs

| SEQ ID NUMBER | Ab region | Sequence |
|---|---|---|
| SEQ ID NO: 443 | VL | QIILSQSPAILSASPGEKVTLTCRASSSVSSMHWYQ QKPGSSPKPWIFATSNLASGVPARFTGSGSGTSYSL TISRVEAEDAATYYCQQWIFNPPTFGGGTSLEIK |
| SEQ ID NO: 444 | DNA VL | CAGATCATTCTGAGCCAGAGCCCGGCCATTCTGT CTGCCTCGCCTGGAGAAAAAGTCACCCTCACTTG CCGGGCCAGCTCCTCCGTGTCCTCAATGCACTGG TACCAGCAGAAGCCTGGCTCAAGCCCGAAGCCC TGGATCTTCGCCACCTCCAATCTGGCGTCAGGAG TGCCCGCGAGGTTCACTGGATCGGGGTCCGGCA CATCGTATTCGCTCACCATTTCCCGGGTGGAGGC CGAGGACGCCGCTACTTACTACTGCCAACAGTG GATCTTCAACCCACCGACCTTTGGCGGAGGGACT TCCTTGGAAATCAAG |

CD20-C6

| SEQ ID NO: 445 | VH | QIQLVQSGPELKKPGETVKISCKTSGYTFTSHGINW VKQAPRKGLKWMGWINTYTGEPTYGDDFKGRFA FSLETSARTAYLQINNLKNEDTATYFCARYGNYEE PYAMDYWGQGTSVTVSS |
| SEQ ID NO: 446 | DNA VH | CAAATTCAGCTGGTGCAGTCGGGACCTGAGCTC AAGAAGCCCGGAGAAACCGTGAAGATCTCCTGC AAGACTTCCGGGTACACTTTTACTTCCCACGGCA TCAACTGGGTCAAGCAGGCACCAAGGAAGGGGC TTAAGTGGATGGGCTGGATTAACACCTACACCG GCGAACCCACCTATGGCGATGACTTCAAAGGAC GGTTCGCGTTCTCCCTCGAAACCTCAGCAAGAAC CGCGTATTTGCAAATCAACAACCTGAAGAACGA GGACACCGCCACCTACTTCTGCGCCCGCTACGGA AATTACGAGGAACCTTACGCTATGGACTACTGG GGCCAGGGCACTTCCGTGACTGTGTCGTCC |
| SEQ ID NO: 447 | VL | QIVLSQSPAILSASPGEKVTMTCRATSSVSSMNWY QQKPGSFPRPWIHATSNLASGVPARFSGSGSGTSYS LTISRVEAEDAATYYCQQWTFNPPTFGAGAKLELK |
| SEQ ID NO: 448 | DNA VL | CAGATCGTGCTGAGCCAGAGCCCCGCCATCCTG AGCGCTTCCCCGGGAGAAAAGGTCACCATGACT TGCCGGGCCACTAGCAGCGTGTCCTCCATGAACT GGTACCAGCAGAAGCCGGGCTCCTTCCCTCGCCC CTGGATTCATGCCACCTCAAACCTGGCCAGCGGA GTGCCAGCCAGATTCTCGGGATCTGGATCGGGG ACGTCCTACTCCCTCACCATCTCGCGGGTGGAGG CCGAAGATGCCGCCACATACTACTGTCAACAGT GGACCTTCAACCCGCCGACCTTTGGAGCGGGGG CCAAGCTGGAGCTGAAA |

CD20-C7

| SEQ ID NO: 449 | VH | QVQLQQPGAELVKPGASVKMSCKASGYTFTSYNI HWVKQTPGQGLEWIGAIYPGNGDTSYNQKFKGKA TLTADKSSTTAFIHFSSLTSEDSVVYYCARSYFYGS DSWYFDVWGAGTTVTVSS |
| SEQ ID NO: 450 | DNA VH | CAAGTGCAGCTTCAGCAGCCTGGGGCCGAACTC GTGAAGCCAGGAGCCTCCGTGAAGATGTCATGC AAAGCCTCCGGCTACACTTTTACCTCCTACAACA TTCATTGGGTCAAGCAGACACCTGGCCAGGGCCT GGAATGGATTGGTGCAATCTACCCGGGCAACGG AGACACCTCGTACAACCAGAAGTTTAAGGGGAA GGCCACCCTGACCGCGGACAAGTCAAGCACTAC CGCGTTCATTCACTTCTCGTCCTTGACCTCCGAG GATAGCGTGGTGTACTACTGCGCCCGCTCCTATT TCTACGGCTCCGATTCGTGGTACTTCGACGTCTG GGGAGCCGGAACTACCGTGACCGTGTCCTCC |
| SEQ ID NO: 451 | VL | QIILSQSPAILSASPGEKVTLTCRASSGVPSLHWYQQ KPGSSPKPWIFATSNLASGVPARFSGSGSGTSYSLTI SRVEAEDAATYYCQQWIFNPPTFGGGTSLEIK |
| SEQ ID NO: 452 | DNA VL | CAAATCATCCTGAGCCAGAGCCCGGCCATCCTGT CGGCTTCACCCGGGGAAAAGGTCACGCTGACTT |

TABLE 1-continued

CD20 CAR Constructs

| SEQ ID NUMBER | Ab region | Sequence |
|---|---|---|
| | | GCCGGGCCTCCTCCGGCGTGCCAAGCCTCCACTG GTACCAGCAAAAGCCTGGCTCGTCCCCAAACC CTGGATTTTCGCCACCTCCAACCTGGCTAGCGGA GTGCCGGCCAGATTCTCGGGTTCCGGGTCCGGCA CCAGCTATTCTCTCACCATCTCCCGGGTCGAGGC GGAGGACGCAGCGACTTACTACTGTCAACAGTG GATCTTCAATCCGCCCACCTTCGGCGGAGGAACT TCCCTGGAAATCAAG |

CD20-C8

| SEQ ID NO: 453 | VH | QVQLLQPGAELVKPGASVKMSCKASGYTFTRYNM HWVKQTPGQGLEWIGAIYPGNGDTSYSQKFKGKA TLTADKSSSTAYMQLSSLTSEDSAVYYCARSFFYG SSDWYFDVWGAGTTVSVSS |
| SEQ ID NO: 454 | DNA VH | CAAGTGCAGCTGCTGCAGCCCGGAGCCGAACTC GTGAAGCCGGGCGCATCCGTGAAAATGAGCTGC AAGGCGTCCGGTTACACCTTCACTCGCTACAACA TGCACTGGGTCAAGCAGACCCCTGGACAAGGCC TGGAGTGGATTGGTGCTATCTACCCGGGAAACG GAGACACTAGCTACTCGCAGAAATTCAAGGGAA AGGCCACGCTGACCGCCGATAAGTCCTCCTCCAC TGCCTACATGCAACTCAGCTCACTGACCTCAGAG GACTCGGCCGTGTACTACTGCGCGAGGTCCTTCT TCTACGGGTCCTCGGATTGGTACTTCGACGTCTG GGGCGCCGGTACCACCGTGTCCGTGTCATCC |
| SEQ ID NO: 455 | VL | QIVLSQSPAILSTSPGEKVTLTCRASSSVNNMHWYQ QKPGSSPKPWIYATSNLASGVPSRFSGSGSGTSYSL TISRVEAEDAATYYCQQWIFNPPTFGAGTKLELK |
| SEQ ID NO: 456 | DNA VL | CAGATCGTGCTGAGCCAGTCCCCGGCGATTCTGT CCACCTCGCCTGGGGAAAAGGTCACCCTGACAT GTAGAGCCTCCTCCTCCGTGAACAATATGCATTG GTATCAGCAGAAGCCAGGATCAAGCCCCAAGCC CTGGATCTATGCCACTTCGAACCTTGCCTCTGGA GTGCCCTCACGGTTCTCCGGCTCGGGATCGGGGA CCAGCTACAGCTTGACTATCTCCCGGGTGGAGGC TGAGGACGCCGCAACCTACTACTGCCAGCAATG GATCTTCAACCCTCCGACTTTTGGGGCCGGAACC AAGCTGGAACTCAAG |

CD20-3m

| SEQ ID NO: 457 | VH | QVQLVESGGGVVQPGRSLRLSCAASGFTFRDYYM AWVRQAPGKGLEWVASISYEGNPYYGDSVKGRFT ISRDNAKSTLYLQMSSLRAEDTAVYYCARHDHNN VDWFAYWGQGTLVTV |
| SEQ ID NO: 458 | DNA VH | CAAGTGCAGTTGGTGGAATCAGGAGGAGGTGTC GTGCAACCAGGAAGATCATTGAGGCTCTCATGC GCCGCCAGCGGATTCACCTTTCGGGATTACTACA TGGCCTGGGTCCGCCAGGCCCCGGGGAAGGGAC TGGAATGGGTGGCATCCATCTCGTACGAAGGGA ACCCCTACTATGGGGACTCCGTGAAGGGACGGT TCACCATCTCCCGGGACAACGCCAAGTCCACCCT GTACCTTCAAATGTCCTCGCTGAGGGCGGAGGAT ACTGCTGTCTACTACTGTGCCCGCCACGACCATA ACAACGTGGACTGGTTCGCCTACTGGGGCCAGG GAACCCTCGTCACCGTGTCCTCG |
| SEQ ID NO: 459 | VL | DIVMTQTPLSLSVTPGQPVSMSCKSSQSLLYSENKK NYLAWYLQKPGQSPQLLIFWASTRESGVPDRFSGS GSGTDFTLKISRVEAEDVGVYYCQQYYNFPTFGQG TKLEIK |
| SEQ ID NO: 460 | DNA VL | GACATTGTGATGACGCAGACTCCCCTGTCGCTCT CCGTGACCCCTGGCCAGCCCGTGTCGATGTCGTG CAAGAGCTCCCAGTCCCTGCTGTATTCCGAGAAC AAGAAGAATTACCTTGCGTGGTACCTCCAGAAG CCGGGGCAGAGCCCGCAGCTGCTGATTTTCTGGG CGTCCACTAGAGAGTCTGGAGTGCCTGACCGGTT TAGCGGAAGCGGCTCCGGTACTGATTTCACCCTG AAAATCTCGCGCGTGGAAGCTGAGGACGTGGGC |

TABLE 1-continued

CD20 CAR Constructs

| SEQ ID NUMBER | Ab region | Sequence |
|---|---|---|
| | | GTGTACTACTGCCAGCAGTACTACAACTTCCCTA<br>CTTTCGGACAAGGAACCAAGCTGGAAATCAAG |
| SEQ ID NO: 461 | Linker | GGGGSGGGGSGGGGSGGGGS |
| SEQ ID NO: 462 | scFv (VH-linker-VL) | QVQLVESGGGVVQPGRSLRLSCAASGFTFRDYYM<br>AWVRQAPGKGLEWVASISYEGNPYYGDSVKGRFT<br>ISRDNAKSTLYLQMSSLRAEDTAVYYCARHDHNN<br>VDWFAYWGQGTLVTVSSGGGGSGGGGSGGGGSG<br>GGGSDIVMTQTPLSLSVTPGQPVSMSCKSSQSLLYS<br>ENKKNYLAWYLQKPGQSPQLLIFWASTRESGVPD<br>RFSGSGSGTDFTLKISRVEAEDVGVYYCQQYYNFP<br>TFGQGTKLEIK |

CD20-3J

| SEQ ID NO: 463 | VH | QVQLVQSGAEVKKPGASVKVSCKASGFTFRDYYM<br>AWVRQAPGQRLEWMGSISYEGNPYYGDSVKGRV<br>TITRDNSASTLYMELSSLRSEDTAVYYCARHDHNN<br>VDWFAYWGQGTLVTVSS |
| SEQ ID NO: 464 | DNA VH | CAAGTCCAACTCGTCCAGTCCGGTGCAGAAGTC<br>AAGAAACCAGGAGCTTCCGTGAAAGTGTCGTGC<br>AAAGCTTCAGGCTTCACCTTCCGCGACTATTACA<br>TGGCCTGGGTCCGCCAAGCGCCCGGACAGCGGC<br>TGGAGTGGATGGGGTCCATTTCCTACGAGGGGA<br>ACCCCTACTATGGAGATTCCGTGAAGGGCAGAG<br>TGACGATCACTCGGGATAACTCCGCCTCCACTCT<br>CTACATGGAACTGTCCTCGCTTCGGAGCGAAGAT<br>ACCGCGGTGTACTACTGCGCCCGCCACGACCATA<br>ACAACGTGGACTGGTTCGCCTACTGGGGACAGG<br>GGACCCTCGTGACCGTGTCCTCT |
| SEQ ID NO: 465 | VL | DIQMTQSPSSLSASVGDRVTITCKSSQSLLYSENKK<br>NYLAWYQQKPGKVPKLLIFWASTRESGVPSRFSGS<br>GSGTDFTLTISSLQPEDVATYYCQQYYNFPTFGQGT<br>KLEIK |
| SEQ ID NO: 466 | DNA VL | GACATTCAGATGACCCAGTCCCCGAGCTCGCTGT<br>CCGCCTCCGTGGGAGACAGAGTGACAATCACTT<br>GCAAGAGCAGCCAGTCACTGTTGTACTCCGAGA<br>ACAAGAAGAACTACCTCGCCTGGTACCAGCAGA<br>AGCCGGGAAAGGTCCCTAAGCTGCTGATCTTCTG<br>GGCCAGCACTAGGGAGTCGGGAGTGCCGTCACG<br>GTTCAGCGGATCGGGATCGGGTACCGACTTCACC<br>CTGACTATCTCCTCCCTGCAACCTGAGGACGTGG<br>CCACCTACTACTGTCAGCAGTACTACAATTTTCC<br>CACCTTCGGCCAGGGTACCAAGCTGGAAATCAAG |
| SEQ ID NO: 467 | Linker | GGGGSGGGGSGGGGSGGGGS |
| SEQ ID NO: 468 | scFv (VH-linker-VL) | QVQLVQSGAEVKKPGASVKVSCKASGFTFRDYYM<br>AWVRQAPGQRLEWMGSISYEGNPYYGDSVKGRV<br>TITRDNSASTLYMELSSLRSEDTAVYYCARHDHNN<br>VDWFAYWGQGTLVTVSSGGGGSGGGGSGGGGSG<br>GGGSDIQMTQSPSSLSASVGDRVTITCKSSQSLLYS<br>ENKKNYLAWYQQKPGKVPKLLIFWASTRESGVPS<br>RFSGSGSGTDFTLTISSLQPEDVATYYCQQYYNFPT<br>FGQGTKLEIK |

CD20-3H5k1

| SEQ ID NO: 469 | VH | EVQLVQSGAEVKKPGESLKISCKGSGFTFRDYYMA<br>WVRQMPGKGLEWMGSISYEGNPYYGDSVKGQVTI<br>SRDNSISTLYLQWSSLKASDTAMYYCARHDHNNV<br>DWFAYWGQGTLVTVSS |
| SEQ ID NO: 470 | DNA VH | GAAGTCCAACTGGTGCAGTCAGGAGCAGAAGTC<br>AAAAAACCAGGAGAAAGCCTCAAGATCAGCTGC<br>AAGGGCTCGGGTTTCACCTTCCGGGACTACTATA<br>TGGCCTGGGTCAGACAGATGCCGGGAAAGGGAC<br>TGGAATGGATGGGGTCAATCAGCTACGAGGGCA<br>ACCCCTACTACGGAGACTCCGTGAAGGGACAGG |

TABLE 1-continued

CD20 CAR Constructs

| SEQ ID NUMBER | Ab region | Sequence |
|---|---|---|
| | | TCACAATCTCCCGGGACAACTCGATTTCCACTCT<br>GTATCTGCAATGGAGCTCCCTCAAGGCCTCCGAC<br>ACTGCGATGTACTACTGTGCGCGGCATGACCACA<br>ACAATGTGGATTGGTTCGCCTACTGGGGACAGG<br>GAACCCTCGTGACCGTGTCCAGC |
| SEQ ID NO: 471 | VL | DIQMTQSPSSLSASVGDRVTITCKSSQSLLYSENKK<br>NYLAWYQQKPGKVPKLLIFWASTRESGVPSRFSGS<br>GSGTDFTLTISSLQPEDVATYYCQQYYNFPTFGQGT<br>KLEIK |
| SEQ ID NO: 472 | DNA VL | GATATCCAAATGACCCAGTCGCCCTCCTCACTCT<br>CCGCCTCCGTGGGAGATCGCGTGACCATTACTTG<br>CAAGAGCTCGCAGTCCCTGCTGTACTCCGAGAAC<br>AAGAAGAACTACTTGGCCTGGTACCAGCAGAAG<br>CCCGGCAAAGTGCCGAAGCTGCTTATCTTTTGGG<br>CCTCGACCAGGGAAAGCGGAGTGCCGTCACGCT<br>TCTCCGGCTCCGGGTCTGGCACCGACTTCACTCT<br>GACTATTTCCTCCCTGCAACCTGAGGACGTGGCT<br>ACCTACTACTGCCAGCAGTACTACAACTTCCCTA<br>CCTTCGGCCAAGGGACGAAGCTGGAGATCAAG |
| SEQ ID NO: 473 | Linker | GGGGSGGGGSGGGGSGGGGS |
| SEQ ID NO: 474 | scFv (VH-linker-VL) | EVQLVQSGAEVKKPGESLKISCKGSGFTFRDYYMA<br>WVRQMPGKGLEWMGSISYEGNPYYGDSVKGQVTI<br>SRDNSISTLYLQWSSLKASDTAMYYCARHDHNNV<br>DWFAYWGQGTLVTVSSGGGGSGGGGSGGGGSGG<br>GGSDIQMTQSPSSLSASVGDRVTITCKSSQSLLYSE<br>NKKNYLAWYQQKPGKVPKLLIFWASTRESGVPSR<br>FSGSGSGTDFTLTISSLQPEDVATYYCQQYYNFPTF<br>GQGTKLEIK |

CD20-3H5k3

| SEQ ID NO: 475 | VH | EVQLVQSGAEVKKPGESLKISCKGSGFTFRDYYMA<br>WVRQMPGKGLEWMGSISYEGNPYYGDSVKGQVTI<br>SRDNSISTLYLQWSSLKASDTAMYYCARHDHNNV<br>DWFAYWGQGTLVTVSS |
| SEQ ID NO: 476 | DNA VH | GAAGTGCAGTTGGTCCAATCAGGCGCAGAAGTG<br>AAGAAACCCGGAGAATCATTGAAGATTTCGTGC<br>AAAGGAAGCGGGTTCACATTCCGCGATTACTAC<br>ATGGCGTGGGTCAGACAGATGCCGGGAAAGGGA<br>CTCGAGTGGATGGGGTCCATCAGCTACGAAGGA<br>AACCCTTACTACGGGGACTCCGTGAAGGGCCAG<br>GTCACCATCTCCCGCGACAACTCAATCTCCACTC<br>TGTATCTGCAATGGTCGAGCCTCAAGGCCTCTGA<br>TACTGCGATGTACTACTGCGCTCGGCATGACCAC<br>AACAACGTGGACTGGTTCGCTTACTGGGGACAG<br>GGTACCCTTGTGACCGTGTCCTCC |
| SEQ ID NO: 477 | VL | EIVMTQSPATLSLSPGERATLSCKSSQSLLYSENKK<br>NYLAWYQQKPGQAPRLLIFWASTRESGIPARFSGS<br>GSGTDFTLTISSLQPEDLAVYYCQQYYNFPTFGQGT<br>KLEIK |
| SEQ ID NO: 478 | DNA VL | GAGATCGTGATGACTCAGTCCCCTGCCACCCTCT<br>CGCTGTCCCCCGGGGAGAGGGCCACGCTGTCCT<br>GCAAGAGCTCCCAGTCACTGCTGTATTCCGAAAA<br>CAAGAAGAACTACCTCGCCTGGTACCAACAGAA<br>GCCGGGACAGGCCCCGCGGCTTCTGATCTTCTGG<br>GCCTCCACTCGGGAGTCCGGCATTCCGGCCCGCT<br>TCTCCGGCTCGGGGAGCGGAACTGACTTCACCCT<br>GACCATCAGCAGCCTGCAGCCAGAGGACCTCGC<br>AGTGTACTACTGTCAACAGTACTACAATTTCCCC<br>ACCTTTGGCCAGGGTACCAAGCTGGAGATTAAG |
| SEQ ID NO: 479 | Linker | GGGGSGGGGSGGGGSGGGGS |
| SEQ ID NO: 480 | scFv (VH-linker-VL) | EVQLVQSGAEVKKPGESLKISCKGSGFTFRDYYMA<br>WVRQMPGKGLEWMGSISYEGNPYYGDSVKGQVTI<br>SRDNSISTLYLQWSSLKASDTAMYYCARHDHNNV |

TABLE 1-continued

CD20 CAR Constructs

| SEQ ID NUMBER | Ab region | Sequence |
|---|---|---|
| | | DWFAYWGQGTLVTVSSGGGGSGGGGSGGGGSGG GGSEIVMTQSPATLSLSPGERATLSCKSSQSLLYSE NKKNYLAWYQQKPGQAPRLLIFWASTRESGIPARF SGSGSGTDFTLTISSLQPEDLAVYYCQQYYNFPTFG QGTKLEIK |

CD20-Ofa

| SEQ ID NO: 481 HCDR1 (Kabat) | DYAMH |
| SEQ ID NO: 482 HCDR2 (Kabat) | TISWNSGSIGYADSVKG |
| SEQ ID NO: 483 HCDR3 (Kabat) | DIQYGNYYYGMDV |
| SEQ ID NO: 484 HCDR1 (Chothia) | GFTFNDY |
| SEQ ID NO: 485 HCDR2 (Chothia) | SWNSGS |
| SEQ ID NO: 486 HCDR3 (Chothia) | DIQYGNYYYGMDV |
| SEQ ID NO: 487 HCDR1 (IMGT) | GFTFNDYA |
| SEQ ID NO: 488 HCDR2 (IMGT) | ISWNSGSI |
| SEQ ID NO: 489 HCDR3 (IMGT) | AKDIQYGNYYYGMDV |
| SEQ ID NO: 490 VH | EVQLVESGGGLVQPGRSLRLSCAASGFTFNDYAMHWV RQAPGKGLEWVSTISWNSGSIGYADSVKGRFTISRDNA KKSLYLQMNSLRAEDTALYYCAKDIQYGNYYYGMDV WGQGTTVTVSS |
| SEQ ID NO: 491 DNA VH | GAGGTGCAGCTGGTCGAGTCGGGGGGAGGATTGGTG CAGCCGGGCAGAAGCCTGCGGCTCTCATGTGCCGCCT CCGGCTTCACCTTTAACGACTACGCAATGCACTGGGT CAGACAGGCTCCTGGGAAGGGCCTGGAATGGGTGTC CACCATTTCCTGGAACTCCGGGAGCATCGGCTACGCT GACTCCGTGAAGGGCCGCTTCACGATTAGCCGCGATA ACGCGAAAAAGAGCCTGTACCTCCAAATGAACTCCC TGCGGGCCGAAGATACCGCCCTTTACTACTGCGCGAA GGACATTCAGTATGGAAACTACTACTACGGAATGGA CGTCTGGGGACAGGGGACCACAGTGACCGTGTCAAGC |
| SEQ ID NO: 492 LCDR1 (Kabat) | RASQSVSSYLA |
| SEQ ID NO: 493 LCDR2 (Kabat) | DASNRAT |
| SEQ ID NO: 494 LCDR3 (Kabat) | QQRSNWPIT |
| SEQ ID NO: 495 LCDR1 (Chothia) | SQSVSSY |
| SEQ ID NO: 496 LCDR2 (Chothia) | DAS |
| SEQ ID NO: 497 LCDR3 (Chothia) | RSNWPI |
| SEQ ID NO: 498 LCDR1 (IMGT) | QSVSSY |
| SEQ ID NO: 499 LCDR2 (IMGT) | DAS |

TABLE 1-continued

CD20 CAR Constructs

| SEQ ID NUMBER | Ab region | Sequence |
|---|---|---|
| SEQ ID NO: 500 (IMGT) | LCDR3 | QQRSNWPIT |
| SEQ ID NO: 501 | VL | EIVLTQSPATLSLSPGERATLSCRASQSVSSYLAWYQQK PGQAPRLLIYDASNRATGIPARFSGSGSGTDFTLTISSLEP EDFAVYYCQQRSNWPITFGQGTRLEIK |
| SEQ ID NO: 502 | DNA VL | GAAATCGTGCTGACCCAGAGCCCAGCCACTTTGTCAC TGTCCCCCGGCGAAAGAGCCACTCTGTCCTGCCGGGC ATCGCAGTCCGTGTCGTCCTACCTGGCCTGGTACCAG CAAAAGCCCGGACAAGCCCCTCGCCTTCTCATCTACG ACGCCTCCAATCGCGCGACCGGAATCCCGGCCAGGTT CTCCGGGAGCGGTTCAGGCACTGACTTCACCCTGACC ATCTCGTCCCTGGAGCCGGAGGATTTCGCCGTGTATT ACTGCCAGCAGCGGTCCAACTGGCCCATCACCTTCGG CCAAGGGACTCGGCTCGAAATCAAG |
| SEQ ID NO: 503 | Linker | GGGGSGGGGSGGGGSGGGGS |
| SEQ ID NO: 504 | scFv (VH-linker-VL) | EVQLVESGGGLVQPGRSLRLSCAASGFTFNDYAMHWV RQAPGKGLEWVSTISWNSGSIGYADSVKGRFTISRDNA KKSLYLQMNSLRAEDTALYYCAKDIQYGNYYYGMDV WGQGTTVTVSSGGGGSGGGGSGGGGSGGGGSEIVLTQ SPATLSLSPGERATLSCRASQSVSSYLAWYQQKPGQAP RLLIYDASNRATGIPARFSGSGSGTDFTLTISSLEPEDFAV YYCQQRSNWPITFGQGTRLEIK |
| SEQ ID NO: 505 | DNA scFv (VH-linker-VL) | GAGGTGCAGCTGGTCGAGTCGGGGGGAGGATTGGTG CAGCCGGGCAGAAGCCTGCGGCTCTCATGTGCCGCCT CCGGCTTCACCTTTAACGACTACGCAATGCACTGGGT CAGACAGGCTCCTGGGAAGGGCCTGGAATGGGTGTC CACCATTTCCTGGAACTCCGGGAGCATCGGCTACGCT GACTCCGTGAAGGGCCGCTTCACGATTAGCCGCGATA ACGCGAAAAAGAGCCTGTACCTCCAAATGAACTCCC TGCGGGCCGAAGATACCGCCCTTTACTACTGCGCGAA GGACATTCAGTATGGAAACTACTACTACGGAATGGA CGTCTGGGGACAGGGGACCACAGTGACCGTGTCAAG CGGCGGTGGAGGATCTGGCGGAGGAGGTTCCGGTGG CGGTGGATCGGAGGGGGAGGATCGGAAATCGTGCT GACCCAGAGCCCAGCCACTTTGTCACTGTCCCCCGGC GAAAGAGCCACTCTGTCCTGCCGGGCATCGCAGTCCG TGTCGTCCTACCTGGCCTGGTACCAGCAAAAGCCCGG ACAAGCCCCTCGCCTTCTCATCTACGACGCCTCCAAT CGCGCGACCGGAATCCCGGCCAGGTTCTCCGGGAGC GGTTCAGGCACTGACTTCACCCTGACCATCTCGTCCC TGGAGCCGGAGGATTTCGCCGTGTATTACTGCCAGCA GCGGTCCAACTGGCCCATCACCTTCGGCCAAGGGACT CGGCTCGAAATCAAG |

CD20-3

| SEQ ID NO: 506 | VH | EVQLVESGGGLVQPGRSLKLSCAASGFTFRDYYMAWV RQAPKKGLEWVASISYEGNPYYGDSVKGRFTISRNNAK STLYLQMNSLRSEDTATYYCARHDHNNVDWFAYWGQ GTLVTVSS |
| SEQ ID NO: 507 | DNA VH | |
| SEQ ID NO: 508 | VL | DIVMTQTPSSQAVSAGEKVTMSCKSSQSLLYSENKKNY LAWYQQKPGQSPKLLIFWASTRESGVPDRFIGSGSGTDF TLTISSVQAEDLAVYYCQQYYNFPTFGSGTKLEIK |
| SEQ ID NO: 509 | DNA VL | |
| SEQ ID NO: 510 | Linker | GGGGSGGGGSGGGGSGGGGS |
| SEQ ID NO: 511 | scFv (VH-linker-VL) | EVQLVESGGGLVQPGRSLKLSCAASGFTFRDYYMAWV RQAPKKGLEWVASISYEGNPYYGDSVKGRFTISRNNAK STLYLQMNSLRSEDTATYYCARHDHNNVDWFAYWGQ |

TABLE 1-continued

CD20 CAR Constructs

| SEQ ID NUMBER | Ab region | Sequence |
|---|---|---|
| | | GTLVTVSSGGGGSGGGGSGGGGSGGGGSDIVMTQTPSS QAVSAGEKVTMSCKSSQSLLYSENKKNYLAWYQQKPG QSPKLLIFWASTRESGVPDRFIGSGSGTDFTLTISSVQAE DLAVYYCQQYYNFPTFGSGTKLEIK |

CD20-8aBBz

| SEQ ID NO: 512 | VH | EVQLQQSGAELVKPGASVKMSCKASGYTFTSYNMHW VKQTPGQGLEWIGAIYPGNGDTSYNQKFKGKATLTAD KSSSTAYMQLSSLTSEDSADYYCARSNYYGSSYWFFDV WGAGTTVTVSS |
| SEQ ID NO: 513 | DNA VH | GAGGTGCAACTGCAGCAGTCAGGAGCAGAACTGGTC AAGCCGGGCGCATCCGTCAAGATGAGCTGCAAGGCC TCAGGATACACCTTCACTTCATACAACATGCACTGGG TCAAGCAGACGCCTGGGCAGGGGCTGGAGTGGATCG GTGCCATCTACCCCGGAAACGGCGACACCTCCTACAA CCAGAAGTTCAAGGGAAAGGCCACCCTCACCGCTGA TAAGTCCAGCAGCACCGCCTACATGCAACTGTCGTCC CTGACTTCGGAGGACAGCGCTGACTACTATTGCGCCC GCTCTAATTACTACGGTTCCTCCTACTGGTTCTTCGAC GTGTGGGGCGCGGGTACCACTGTGACTGTCTCCAGC |
| SEQ ID NO: 514 | VL | DIVLTQSPAILSASPGEKVTMTCRASSSVNYMDWYQKK PGSSPKPWIYATSNLASGVPARFSGSGSGTSYSLTISRVE AEDAATYYCQQWSFNPPTFGGGTKLEIK |
| SEQ ID NO: 515 | DNA VL | GACATCGTGCTCACTCAGTCGCCCGCCATTCTGAGCG CTAGCCCCGGCGAAAAGGTCACCATGACCTGTAGAG CGTCATCCTCGGTGAACTACATGGACTGGTACCAGAA GAAGCCGGGATCGAGCCCTAAGCCATGGATCTACGC CACATCCAATCTGGCGTCCGGCGTGCCGGCCCGGTTC AGCGGGAGCGGCTCAGGCACCTCCTATTCCCTCACCA TCTCGAGAGTGGAGGCTGAGGATGCAGCCACGTACT ACTGTCAGCAGTGGTCGTTCAACCCCCCAACCTTTGG TGGTGGAACCAAGCTGGAAATCAAG |
| SEQ ID NO: 516 | Linker | GSTSGGGSGGGSGGGGSS |
| SEQ ID NO: 517 | scFv (VH-linker-VL) | DIVLTQSPAILSASPGEKVTMTCRASSSVNYMDWYQKK PGSSPKPWIYATSNLASGVPARFSGSGSGTSYSLTISRVE AEDAATYYCQQWSFNPPTFGGGTKLEIKGSTSGGGSGG GSGGGGSSEVQLQQSGAELVKPGASVKMSCKASGYTF TSYNMHWVKQTPGQGLEWIGAIYPGNGDTSYNQKFKG KATLTADKSSSTAYMQLSSLTSEDSADYYCARSNYYGS SYWFFDVWGAGTTVTVSS |
| SEQ ID NO: 518 | DNA scFv (VH-linker-VL) | GACATCGTGCTCACTCAGTCGCCCGCCATTCTGAGCG CTAGCCCCGGCGAAAAGGTCACCATGACCTGTAGAG CGTCATCCTCGGTGAACTACATGGACTGGTACCAGAA GAAGCCGGGATCGAGCCCTAAGCCATGGATCTACGC CACATCCAATCTGGCGTCCGGCGTGCCGGCCCGGTTC AGCGGGAGCGGCTCAGGCACCTCCTATTCCCTCACCA TCTCGAGAGTGGAGGCTGAGGATGCAGCCACGTACT ACTGTCAGCAGTGGTCGTTCAACCCCCCAACCTTTGG TGGTGGAACCAAGCTGGAAATCAAGGGAAGCACCTC CGGCGGAGGTTCCGGAGGAGGGTCCGGAGGCGGAGG CAGCTCCGAGGTGCAACTGCAGCAGTCAGGAGCAGA ACTGGTCAAGCCGGGCGCATCCGTCAAGATGAGCTG CAAGGCCTCAGGATACACCTTCACTTCATACAACATG CACTGGGTCAAGCAGACGCCTGGGCAGGGGCTGGAG TGGATCGGTGCCATCTACCCCGGAAACGGCGACACCT CCTACAACCAGAAGTTCAAGGGAAAGGCCACCCTCA CCGCTGATAAGTCCAGCAGCACCGCCTACATGCAACT GTCGTCCCTGACTTCGGAGGACAGCGCTGACTACTAT TGCGCCCGCTCTAATTACTACGGTTCCTCCTACTGGTT CTTCGACGTGTGGGGCGCGGGTACCACTGTGACTGTC TCCAGC |

An overview of the sequences identifications of CDR (Kabat) sequences of the CD20 scFv domains of Table 1 are shown in Table 2 for the heavy chain variable domains and in Table 3 for the light chain variable domains. The SEQ ID NO's refer to those found in Table 1.

TABLE 2

Heavy Chain Variable Domain CDR (Kabat) SEQ ID NO's of CD20 antibody molecules

| Candidate | HCDR1 | HCDR2 | HCDR3 |
|---|---|---|---|
| CD20-C3H2 | 136 | 137 | 138 |
| CD20-C5H1 | 217 | 218 | 219 |
| CD20-C2H1 | 1 | 2 | 3 |
| CD20-C2H2 | 28 | 29 | 30 |
| CD20-C2H3 | 55 | 56 | 57 |
| CD20-C2H4 | 82 | 83 | 84 |
| CD20-C3H1 | 109 | 110 | 111 |
| CD20-C3H3 | 163 | 164 | 165 |
| CD20-C3H4 | 190 | 191 | 192 |
| CD20-C5H2 | 244 | 245 | 246 |
| CD20-C5H3 | 271 | 272 | 273 |
| CD20-C5H4 | 298 | 299 | 300 |
| CD20-C8H1 | 325 | 326 | 327 |
| CD20-C8H2 | 352 | 353 | 354 |
| CD20-C8H3 | 379 | 380 | 381 |
| CD20-C8H4 | 406 | 407 | 408 |

TABLE 3

Light Chain Variable Domain CDR (Kabat) SEQ ID NO's of CD20 Antibody Molecules

| Candidate | LCDR1 | LCDR2 | LCDR3 |
|---|---|---|---|
| CD20-C3H2 | 147 | 148 | 149 |
| CD20-C5H1 | 228 | 229 | 230 |
| CD20-C2H1 | 12 | 13 | 14 |
| CD20-C2H2 | 39 | 40 | 41 |
| CD20-C2H3 | 66 | 67 | 68 |
| CD20-C2H4 | 93 | 94 | 95 |
| CD20-C3H1 | 120 | 121 | 122 |
| CD20-C3H3 | 174 | 175 | 176 |
| CD20-C3H4 | 201 | 202 | 203 |
| CD20-C5H2 | 255 | 256 | 257 |
| CD20-C5H3 | 282 | 283 | 284 |
| CD20-C5H4 | 309 | 310 | 311 |
| CD20-C8H1 | 336 | 337 | 338 |
| CD20-C8H2 | 363 | 364 | 365 |
| CD20-C8H3 | 390 | 391 | 392 |
| CD20-C8H4 | 417 | 418 | 419 |

TABLE 4

Heavy Chain Variable Region SEQ ID NO's of CD20 antibody molecules

| Candidate | Heavy Chain Variable region |
|---|---|
| CD20-C3H2 | 145 |
| CD20-C5H1 | 226 |
| CD20-C2H1 | 10 |
| CD20-C2H2 | 37 |
| CD20-C2H3 | 64 |
| CD20-C2H4 | 91 |
| CD20-C3H1 | 118 |
| CD20-C3H3 | 172 |
| CD20-C3H4 | 199 |
| CD20-C5H2 | 253 |
| CD20-C5H3 | 280 |
| CD20-C5H4 | 307 |
| CD20-C8H1 | 334 |
| CD20-C8H2 | 361 |

TABLE 4-continued

Heavy Chain Variable Region SEQ ID NO's of CD20 antibody molecules

| Candidate | Heavy Chain Variable region |
|---|---|
| CD20-C8H3 | 388 |
| CD20-C8H4 | 415 |

TABLE 5

Light Chain Variable Region SEQ ID NO's of CD20 antibody molecules

| Candidate | Light Chain Variable region |
|---|---|
| CD20-C3H2 | 156 |
| CD20-C5H1 | 237 |
| CD20-C2H1 | 21 |
| CD20-C2H2 | 48 |
| CD20-C2H3 | 75 |
| CD20-C2H4 | 102 |
| CD20-C3H1 | 129 |
| CD20-C3H3 | 183 |
| CD20-C3H4 | 210 |
| CD20-C5H2 | 264 |
| CD20-C5H3 | 291 |
| CD20-C5H4 | 318 |
| CD20-C8H1 | 345 |
| CD20-C8H2 | 372 |
| CD20-C8H3 | 399 |
| CD20-C8H4 | 426 |

The CAR scFv fragments were then cloned into lentiviral vectors to create a full length CAR construct in a single coding frame, and using the EF1 alpha promoter for expression (SEQ ID NO: 833). The cloning method is further described in the Examples.

The order in which the VL and VH domains appear in the scFv was varied (i.e., VL-VH, or VH-VL orientation), and where either three or four copies of the "G4S" subunit (SEQ ID NO: 1083), in which each subunit comprises the sequence GGGGS (SEQ ID NO: 834) (e.g., (G4S)$_3$ (SEQ ID NO: 1084) or (G4S)$_4$ (SEQ ID NO: 1086)), connect the variable domains to create the entirety of the scFv domain, as shown e.g. in Table 1.

CD22 CAR Constructs

Anti-CD22 single chain variable fragments were isolated. See Table 6. Anti-CD22 ScFvs were cloned into lentiviral CAR expression vectors comprising the CD3zeta chain and the 4-1BB costimulatory molecule. The cloning method is further described in the Example section. The sequences of the CD22 CARs are provided below in Table 6.

TABLE 6

| | CD22 CAR Constructs | |
|---|---|---|
| SEQ ID NUMBER | Ab region | Sequence |
| CD22-65s, ss or KD | | |
| SEQ ID NO: 834 | Linker | GGGGS |
| CD22-65s SEQ ID NO: 835 | scFv (VH-linker-VL) of CD22-65s (linker shown by italics and underline) | EVQLQQSGPGLVKPSQTLSLTCAISGDSMLSNSDT WNWIRQSPSRGLEWLGRTYHRSTWYDDYASSVRG RVSINVDTSKNQYSLQLNAVTPEDTGVYYCARVRL QDGNSWSDAFDVWGQGTMVTVSS*GGGGS*QSALT QPASASGSPGQSVTISCTGTSSDVGGYNYVSWYQQ HPGKAPKLMIYDVSNRPSGVSNRFSGSKSGNTASL TISGLQAEDEADYYCSSYTSSSTLYVFGTGTQLTVL |
| CD22-65ss SEQ ID NO: 836 | scFv (VH-VL) of CD22-65ss (no linker between VH-VL) | EVQLQQSGPGLVKPSQTLSLTCAISGDSMLSNSDT WNWIRQSPSRGLEWLGRTYHRSTWYDDYASSVRG RVSINVDTSKNQYSLQLNAVTPEDTGVYYCARVRL QDGNSWSDAFDVWGQGTMVTVSSQSALTQPASAS GSPGQSVTISCTGTSSDVGGYNYVSWYQQHPGKAP KLMIYDVSNRPSGVSNRFSGSKSGNTASLTISGLQA EDEADYYCSSYTSSSTLYVFGTGTQLTVL |
| CD22-65sKD SEQ ID NO: 837 | scFv (VH-linker-VL) of CD22-65sKD | EVQLQQSGPGLVKPSQTLSLTCAISGDSMLSNSDT WNWIRKSPSRGLEWLGRTYHRSTWYDDYASSVRG RVSINVDTSKNQYSLQLNAVTPEDTGVYYCARVRL QDGNSWSDAFDVWGQGTMVTVSS*GGGGS*QSALT QPASASGSPGQSVTISCTGTSSDVGGYNYVSWYQD HPGKAPKLMIYDVSNRPSGVSNRFSGSKSGNTASL TISGLQAEDEADYYCSSYTSSSTLYVFGTGTQLTVL |
| SEQ ID NO: 839 | VH of CD22-65sKD | EVQLQQSGPGLVKPSQTLSLTCAISGDSMLSNSDT WNWIRKSPSRGLEWLGRTYHRSTWYDDYASSVRG RVSINVDTSKNQYSLQLNAVTPEDTGVYYCARVRL QDGNSWSDAFDVWGQGTMVTVSS |
| SEQ ID NO: 840 | VL of CD22-65sKD | QSALTQPASASGSPGQSVTISCTGTSSDVGGYNYVS WYQDHPGKAPKLMIYDVSNRPSGVSNRFSGSKSG NTASLTISGLQAEDEADYYCSSYTSSSTLYVFGTGT QLTVL |
| CD22-57 | | |
| SEQ ID NO: 519 (Kabat) | HCDR1 | NNNAAWN |
| SEQ ID NO: 520 (Kabat) | HCDR2 | RTYHRSTWYNDYVGSVKS |
| SEQ ID NO: 521 (Kabat) | HCDR3 | ETDYGDYGAFDI |
| SEQ ID NO: 522 (Chothia) | HCDR1 | GDSVSNNNA |
| SEQ ID NO: 523 (Chothia) | HCDR2 | YHRSTWY |
| SEQ ID NO: 524 (Chothia) | HCDR3 | ETDYGDYGAFDI |
| SEQ ID NO: 525 (IMGT) | HCDR1 | GDSVSNNNAA |
| SEQ ID NO: 526 (IMGT) | HCDR2 | TYHRSTWYN |
| SEQ ID NO: 527 (IMGT) | HCDR3 | ARETDYGDYGAFDI |
| SEQ ID NO: 1100 (Combined Chothia and Kabat) | HCDR1 | GDSVSNNNAAWN |

TABLE 6-continued

CD22 CAR Constructs

| SEQ ID NUMBER | Ab region | Sequence |
|---|---|---|
| SEQ ID NO: 989 (Combined Chothia and Kabat) | HCDR2 | RTYHRSTWYNDYVGSVKS |
| SEQ ID NO: 990 (Combined Chothia and Kabat) | HCDR3 | ETDYGDYGAFDI |
| SEQ ID NO: 528 | VH | EVQLQQSGPGLVKPSQTLSLTCAISGDSVSNNNAAWNWIRQSPSRGLEWLGRTYHRSTWYNDYVGSVKSRITINPDTSKNQFSLQLNSVTPEDTAVYYCARETDYGDYGAFDIWGQGTTVTVSS |
| SEQ ID NO: 529 | DNA VH | GAAGTCCAATTGCAACAATCAGGTCCCGGACTCGTGAAACCTTCCCAAACCCTCTCCCTCACTTGCGCGATCAGCGGAGACTCCGTGTCCAACAACAATGCTGCCTGGAACTGGATTAGGCAGAGCCCTTCAAGAGGACTGGAATGGCTGGGACGGACTTACCACCGCTCCACCTGGTACAACGATTACGTGGGGTCCGTCAAGTCCCGGATCACCATTAACCCGGACACTTCCAAGAATCAGTTCAGCCTGCAACTTAACAGCGTGACTCCCGAGGATACCGCCGTGTACTACTGTGCCCGGGAAACCGACTACGGGGATTACGGAGCCTTCGACATCTGGGGACAGGGAACCACCGTGACCGTGTCCTCG |
| SEQ ID NO: 530 (Kabat) | LCDR1 | TGSRNDIGAYESVS |
| SEQ ID NO: 531 (Kabat) | LCDR2 | GVNNRPS |
| SEQ ID NO: 532 (Kabat) | LCDR3 | SSHTTTSTLYV |
| SEQ ID NO: 533 (Chothia) | LCDR1 | SRNDIGAYES |
| SEQ ID NO: 534 (Chothia) | LCDR2 | GVN |
| SEQ ID NO: 535 (Chothia) | LCDR3 | HTTTSTLY |
| SEQ ID NO: 536 (IMGT) | LCDR1 | RNDIGAYES |
| SEQ ID NO: 537 (IMGT) | LCDR2 | GVN |
| SEQ ID NO: 538 (IMGT) | LCDR3 | SSHTTTSTLYV |
| SEQ ID NO: 991 (Combined Chothia and Kabat) | LCDR1 | TGSRNDIGAYESVS |
| SEQ ID NO: 992 (Combined Chothia and Kabat) | LCDR2 | GVNNRPS |
| SEQ ID NO: 993 (Combined Chothia and Kabat) | LCDR3 | SSHTTTSTLYV |
| SEQ ID NO: 539 | VL | QSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVL |

TABLE 6-continued

CD22 CAR Constructs

| SEQ ID NUMBER | Ab region | Sequence |
|---|---|---|
| SEQ ID NO: 540 | DNA VL | CAGTCGGCCCTGACTCAGCCGGCCTCCGTGTCCG GAAGCCCGGGCCAGTCCATCACCATTTCGTGCAC TGGGTCGCGCAACGACATCGGCGCCTACGAATC CGTGTCGTGGTACCAGCAGCACCCCGGCAACGC CCCGAAGCTGATCATCCATGGCGTCAACAACAG ACCATCCGGAGTGTTCGACCGGTTCAGCGTGTCC CAGTCGGGAAACACCGCATCCCTGACCATTAGC GGCCTGCAGGCGGAGGACGAGGCTGACTATTAC TGCTCCTCACACACCACCACCTCTACGCTCTATG TGTTTGGGACTGGCACCAAGGTCACAGTGCTGGGA |
| SEQ ID NO: 541 | Linker | GGGGSGGGGSGGGGS |
| SEQ ID NO: 542 | scFv (VH-linker-VL) | EVQLQQSGPGLVKPSQTLSLTCAISGDSVSNNNAA WNWIRQSPSRGLEWLGRTYHRSTWYNDYVGSVK SRITINPDTSKNQFSLQLNSVTPEDTAVYYCARETD YGDYGAFDIWGQGTTVTVSSGGGGSGGGGSGGGG SQSALTQPASVSGSPGQSITISCTGSRNDIGAYESVS WYQQHPGNAPKLIIHGVNNRPSGVFDRFSVSQSGN TASLTISGLQAEDEADYYCSSHTTTSTLYVFGTGTK VTVL |
| SEQ ID NO: 543 | DNA scFv (VH-linker-VL) | GAAGTCCAATTGCAACAATCAGGTCCCGGACTCGTG AAACCTTCCCAAACCCTCTCCCTCACTTGCGCGATCA GCGGAGACTCCGTGTCCAACAACAATGCTGCCTGGA ACTGGATTAGGCAGAGCCCTTCAAGAGGACTGGAAT GGCTGGGACGGACTTACCACCGCTCCACCTGGTACAA CGATTACGTGGGGTCCGTCAAGTCCCGGATCACCATT AACCCCGGACACTTCCAAGAATCAGTTCAGCCTGCAAC TTAACAGCGTGACTCCCGAGGATACCGCCGTGTACTA CTGTGCCCGGGAAACCGACTACGGGGATTACGGAGC CTTCGACATCTGGGGACAGGGAACCACCGTGACCGT GTCCTCGGGCGGTGGTGGTTCGGGCGGCGGGGGATC AGGGGGCGGAGGAAGCCAGTCGGCCCTGACTCAGCC GGCCTCCGTGTCCGGAAGCCCGGGCCAGTCCATCACC ATTTCGTGCACTGGGTCGCGCAACGACATCGGCGCCT ACGAATCCGTGTCGTGGTACCAGCAGCACCCCGGCA ACGCCCCGAAGCTGATCATCCATGGCGTCAACAACA GACCATCCGGAGTGTTCGACCGGTTCAGCGTGTCCCA GTCGGGAAACACCGCATCCCTGACCATTAGCGGCCTG CAGGCGGAGGACGAGGCTGACTATTACTGCTCCTCAC ACACCACCACCTCTACGCTCTATGTGTTTGGGACTGG CACCAAGGTCACAGTGCTGGGA |

CD22-58

| SEQ ID NUMBER | Ab region | Sequence |
|---|---|---|
| SEQ ID NO: 544 (Kabat) | HCDR1 | SNSAAWN |
| SEQ ID NO: 545 (Kabat) | HCDR2 | RTFYRSKWYNDYAVSVKG |
| SEQ ID NO: 546 (Kabat) | HCDR3 | GDYYYGLDV |
| SEQ ID NO: 547 (Chothia) | HCDR1 | GDSVSSNSA |
| SEQ ID NO: 548 (Chothia) | HCDR2 | FYRSKWY |
| SEQ ID NO: 549 (Chothia) | HCDR3 | GDYYYGLDV |
| SEQ ID NO: 550 (IMGT) | HCDR1 | GDSVSSNSAA |
| SEQ ID NO: 551 (IMGT) | HCDR2 | TFYRSKWYN |
| SEQ ID NO: 552 (IMGT) | HCDR3 | AGGDYYYGLDV |

TABLE 6-continued

CD22 CAR Constructs

| SEQ ID NUMBER | Ab region | Sequence |
|---|---|---|
| SEQ ID NO: 994 (Combined Chothia and Kabat) | HCDR1 | GDSVSSNSAAWN |
| SEQ ID NO: 995 (Combined Chothia and Kabat) | HCDR2 | RTFYRSKWYNDYAVSVKG |
| SEQ ID NO: 996 (Combined Chothia and Kabat) | HCDR3 | GDYYYGLDV |
| SEQ ID NO: 553 | VH | EVQLQQSGPGLVNPSQTLSITCAISGDSVSSNSAAW NWIRQSPSRGLEWLGRTFYRSKWYNDYAVSVKGR ITISPDTSKNQFSLQLNSVTPEDTAVYYCAGGDYYY GLDVWGQGTTVTVSS |
| SEQ ID NO: 554 | DNA VH | GAAGTCCAGTTGCAACAGTCAGGTCCCGGCCTC GTCAACCCATCCCAAACCCTTTCCATTACCTGTG CCATTAGCGGGGACAGCGTGTCCTCCAACTCGGC CGCTTGGAACTGGATCAGACAGAGCCCCAGCCG GGGTCTGGAGTGGCTGGGACGGACCTTCTACCG CTCAAAGTGGTACAACGACTACGCGGTGTCCGT GAAGGGAAGGATTACCATCTCCCCGGATACATC GAAGAATCAGTTCTCCCTGCAACTGAACTCTGTG ACCCCTGAGGATACCGCCGTGTACTACTGCGCGG GAGGAGACTACTACTATGGGCTGGACGTCTGGG GCCAGGGAACCACCGTGACTGTGTCAAGC |
| SEQ ID NO: 555 (Kabat) | LCDR1 | TGSSSDVGGYNSVS |
| SEQ ID NO: 556 (Kabat) | LCDR2 | EVINRPS |
| SEQ ID NO: 557 (Kabat) | LCDR3 | SSYTSSSTYV |
| SEQ ID NO: 558 (Chothia) | LCDR1 | SSSDVGGYNS |
| SEQ ID NO: 559 (Chothia) | LCDR2 | EVI |
| SEQ ID NO: 560 (Chothia) | LCDR3 | YTSSSTY |
| SEQ ID NO: 561 (IMGT) | LCDR1 | SSDVGGYNS |
| SEQ ID NO: 562 (IMGT) | LCDR2 | EVI |
| SEQ ID NO: 563 (IMGT) | LCDR3 | SSYTSSSTYV |
| SEQ ID NO: 997 (Combined Chothia and Kabat) | LCDR1 | TGSSSDVGGYNSVS |
| SEQ ID NO: 998 (Combined Chothia and Kabat) | LCDR2 | EVINRPS |
| SEQ ID NO: 999 (Combined Chothia and Kabat) | LCDR3 | SSYTSSSTYV |

TABLE 6-continued

CD22 CAR Constructs

| SEQ ID NUMBER | Ab region | Sequence |
| --- | --- | --- |
| SEQ ID NO: 564 | VL | QSALTQPASVSGSPGQSITISCTGSSSDVGGYNSVS WYQQHPGKAPKLMIYEVINRPSGVSHRFSGSKSGN TASLTISGLQAEDEADYYCSSYTSSSTYVFGTGTKV TVL |
| SEQ ID NO: 565 | DNA VL | CAGAGCGCCCTGACCCAGCCGGCCAGCGTGTCC GGGTCGCCGGGCCAGTCGATCACCATCAGCTGC ACTGGGTCATCCTCCGACGTGGGAGGCTACAACT CCGTGTCGTGGTACCAGCAGCACCCGGGGAAGG CTCCTAAGCTGATGATCTACGAAGTGATCAACCG GCCCTCCGGAGTCTCGCATCGCTTTTCCGGTTCA AAGTCCGGAAACACGGCCTCCCTGACCATCTCCG GACTCCAAGCCGAGGATGAAGCAGACTATTACT GCTCCTCGTACACTAGCTCATCCACTTACGTGTT CGGAACTGGCACCAAAGTCACTGTGCTC |
| SEQ ID NO: 566 | Linker | GGGGSGGGGSGGGGS |
| SEQ ID NO: 567 | scFv (VH-linker-VL) | EVQLQQSGPGLVNPSQTLSITCAISGDSVSSNSAAW NWIRQSPSRGLEWLGRTFYRSKWYNDYAVSVKGR ITISPDTSKNQFSLQLNSVTPEDTAVYYCAGGDYYY GLDVWGQGTTVTVSSGGGGSGGGGSGGGGSQSAL TQPASVSGSPGQSITISCTGSSSDVGGYNSVSWYQQ HPGKAPKLMIYEVINRPSGVSHRFSGSKSGNTASLT ISGLQAEDEADYYCSSYTSSSTYVFGTGTKVTVL |
| SEQ ID NO: 568 | DNA scFv (VH-linker-VL) | GAAGTCCAGTTGCAACAGTCAGGTCCCGGCCTCGTCA ACCCATCCCAAACCCTTTCCATTACCTGTGCCATTAG CGGGGACAGCGTGTCCTCCAACTCGGCCGCTTGGAAC TGGATCAGACAGAGCCCCAGCCGGGGTCTGGAGTGG CTGGGACGGACCTTCTACCGCTCAAAGTGGTACAACG ACTACGCGGTGTCCGTGAAGGGAAGGATTACCATCTC CCCGGATACATCGAAGAATCAGTTCTCCCTGCAACTG AACTCTGTGACCCCTGAGGATACCGCCGTGTACTACT GCGCGGGAGGAGACTACTACTATGGGCTGGACGTCT GGGGCCAGGGAACCACCGTGACTGTGTCAAGCGGAG GGGGCGGCTCCGGTGGAGGAGGCTCGGGTGGCGGCG GAAGCCAGAGCGCCCTGACCCAGCCGGCCAGCGTGT CCGGGTCGCCGGGCCAGTCGATCACCATCAGCTGCAC TGGGTCATCCTCCGACGTGGGAGGCTACAACTCCGTG TCGTGGTACCAGCAGCACCCGGGGAAGGCTCCTAAG CTGATGATCTACGAAGTGATCAACCGGCCCTCCGGAG TCTCGCATCGCTTTTCCGGTTCAAAGTCCGGAAACAC GGCCTCCCTGACCATCTCCGGACTCCAAGCCGAGGAT GAAGCAGACTATTACTGCTCCTCGTACACTAGCTCAT CCACTTACGTGTTCGGAACTGGCACCAAAGTCACTGT GCTC |

CD22-59

| SEQ ID NO: 569 (Kabat) | HCDR1 | SNSDTWN |
| --- | --- | --- |
| SEQ ID NO: 570 (Kabat) | HCDR2 | RTYHRSTWYDDYASSVRG |
| SEQ ID NO: 571 (Kabat) | HCDR3 | DRLQDGNSWSDAFDV |
| SEQ ID NO: 572 (Chothia) | HCDR1 | GDSVLSNSD |
| SEQ ID NO: 573 (Chothia) | HCDR2 | YHRSTWY |
| SEQ ID NO: 574 (Chothia) | HCDR3 | DRLQDGNSWSDAFDV |
| SEQ ID NO: 575 (IMGT) | HCDR1 | GDSVLSNSDT |
| SEQ ID NO: 576 (IMGT) | HCDR2 | TYHRSTWYD |

TABLE 6-continued

CD22 CAR Constructs

| SEQ ID NUMBER | Ab region | Sequence |
|---|---|---|
| SEQ ID NO: 577 (IMGT) | HCDR3 | ARDRLQDGNSWSDAFDV |
| SEQ ID NO: 1000 (Combined Chothia and Kabat) | HCDR1 | GDSVLSNSDTWN |
| SEQ ID NO: 1001 (Combined Chothia and Kabat) | HCDR2 | RTYHRSTWYDDYASSVRG |
| SEQ ID NO: 1002 (Combined Chothia and Kabat) | HCDR3 | DRLQDGNSWSDAFDV |
| SEQ ID NO: 578 | VH | EVQLQQSGPGLVKPSQTLSLTCAISGDSVLSNSDT WNWIRQSPSRGLEWLGRTYHRSTWYDDYASSVRG RVSINVDTSKNQYSLQLNAVTPEDTGVYYCARDRL QDGNSWSDAFDVWGQGTMVTVSS |
| SEQ ID NO: 579 | DNA VH | GAAGTCCAATTGCAACAGTCCGGTCCTGGCCTCG TCAAGCCCTCCCAAACCCTCTCCCTGACTTGCGC CATCTCCGGGGATTCCGTGCTGAGCAACTCCGAC ACCTGGAACTGGATTCGGCAGAGCCCGTCCAGA GGCCTGGAGTGGCTGGGCAGGACCTACCACCGG AGCACTTGGTACGACGACTACGCCAGCTCCGTGC GCGGACGCGTGTCAATCAATGTGGACACCTCCA AGAACCAGTACAGCCTGCAACTTAACGCTGTGA CTCCCGAGGATACTGGAGTGTACTATTGTGCCCG CGACCGGCTGCAGGATGGAAACAGCTGGTCCGA TGCCTTCGATGTCTGGGGACAGGGTACCATGGTC ACAGTGTCCAGC |
| SEQ ID NO: 580 (Kabat) | LCDR1 | TGSSSDIGGFNYVS |
| SEQ ID NO: 581 (Kabat) | LCDR2 | EVTNRPS |
| SEQ ID NO: 582 (Kabat) | LCDR3 | SSYASGSPLYV |
| SEQ ID NO: 583 (Chothia) | LCDR1 | SSSDIGGFNY |
| SEQ ID NO: 584 (Chothia) | LCDR2 | EVT |
| SEQ ID NO: 585 (Chothia) | LCDR3 | YASGSPLY |
| SEQ ID NO: 586 (IMGT) | LCDR1 | SSDIGGFNY |
| SEQ ID NO: 587 (IMGT) | LCDR2 | EVT |
| SEQ ID NO: 588 (IMGT) | LCDR3 | SSYASGSPLYV |
| SEQ ID NO: 1003 (Combined Chothia and Kabat) | LCDR1 | TGSSSDIGGFNYVS |
| SEQ ID NO: 1004 (Combined Chothia and Kabat) | LCDR2 | EVTNRPS |

TABLE 6-continued

| | CD22 CAR Constructs | |
|---|---|---|
| SEQ ID NUMBER | Ab region | Sequence |
| SEQ ID NO: 1005 (Combined Chothia and Kabat) | LCDR3 | SSYASGSPLYV |
| SEQ ID NO: 589 | VL | QSALTQPASVSGSPGQSITISCTGSSSDIGGFNYVSW YQQHAGEAPKLMIYEVTNRPSGVSDRFSGSKSDNT ASLTISGLQAEDEADYYCSSYASGSPLYVFGTGTK VTVL |
| SEQ ID NO: 590 | DNA VL | CAGTCCGCGCTGACCCAGCCCGCCTCTGTGTCCG GATCACCGGGACAGTCGATCACGATCTCCTGCAC TGGCTCATCGTCCGACATTGGAGGTTTTAACTAC GTGTCGTGGTACCAGCAGCATGCAGGAGAAGCC CCGAAGCTCATGATCTACGAAGTGACCAACCGG CCTTCGGGGGTGTCAGACAGATTCTCGGGCTCCA AGTCCGACAATACCGCATCCCTGACCATTAGCGG CCTGCAGGCGGAGGACGAAGCCGACTACTATTG CTCCTCGTACGCTTCGGGCTCCCCTCTGTACGTG TTCGGCACTGGGACCAAAGTCACCGTGCTC |
| SEQ ID NO: 591 | Linker | GGGGSGGGGSGGGGS |
| SEQ ID NO: 592 | scFv (VH-linker-VL) | EVQLQQSGPGLVKPSQTLSLTCAISGDSVLSNSDT WNWIRQSPSRGLEWLGRTYHRSTWYDDYASSVRG RVSINVDTSKNQYSLQLNAVTPEDTGVYYCARDRL QDGNSWSDAFDVWGQGTMVTVSSGGGGSGGGGS GGGGSQSALTQPASVSGSPGQSITISCTGSSSDIGGF NYVSWYQQHAGEAPKLMIYEVTNRPSGVSDRFSG SKSDNTASLTISGLQAEDEADYYCSSYASGSPLYVF GTGTKVTVL |
| SEQ ID NO: 593 | DNA scFv (VH-linker-VL) | GAAGTCCAATTGCAACAGTCCGGTCCTGGCCTCGTCA AGCCCTCCCAAACCCTCTCCCTGACTTGCGCCATCTC CGGGGATTCCGTGCTGAGCAACTCCGACACCTGGAA CTGGATTCGGCAGAGCCCGTCCAGAGGCCTGGAGTG GCTGGGCAGGACCTACCACCGGAGCACTTGGTACGA CGACTACGCCAGCTCCGTGCGCGGACGCGTGTCAATC AATGTGGACACCTCCAAGAACCAGTACAGCCTGCAA CTTAACGCTGTGACTCCCGAGGATACTGGAGTGTACT ATTGTGCCCGCGACCGGCTGCAGGATGGAAACAGCT GGTCCGATGCCTTCGATGTCTGGGGACAGGGTACCAT GGTCACAGTGTCCAGCGGGGGGGGCGGATCAGGCGG CGGTGGCTCCGGAGGAGGGGGTTCCCAGTCCGCGCT GACCCAGCCCGCCTCTGTGTCCGGATCACCGGGACAG TCGATCACGATCTCCTGCACTGGCTCATCGTCCGACA TTGGAGGTTTTAACTACGTGTCGTGGTACCAGCAGCA TGCAGGAGAAGCCCCGAAGCTCATGATCTACGAAGT GACCAACCGGCCTTCGGGGGTGTCAGACAGATTCTCG GGCTCCAAGTCCGACAATACCGCATCCCTGACCATTA GCGGCCTGCAGGCGGAGGACGAAGCCGACTACTATT GCTCCTCGTACGCTTCGGGCTCCCCTCTGTACGTGTTC GGCACTGGGACCAAAGTCACCGTGCTC |
| CD22-60 | | |
| SEQ ID NO: 594 (Kabat) | HCDR1 | SNSDTWN |
| SEQ ID NO: 595 (Kabat) | HCDR2 | RTYHRSTWYDDYASSVRG |
| SEQ ID NO: 596 (Kabat) | HCDR3 | DRLQDGNSWSDAFDV |
| SEQ ID NO: 597 (Chothia) | HCDR1 | GDSVLSNSD |
| SEQ ID NO: 598 (Chothia) | HCDR2 | YHRSTWY |
| SEQ ID NO: 599 (Chothia) | HCDR3 | DRLQDGNSWSDAFDV |

TABLE 6-continued

CD22 CAR Constructs

| SEQ ID NUMBER | Ab region | Sequence |
|---|---|---|
| SEQ ID NO: 600 (IMGT) | HCDR1 | GDSVLSNSDT |
| SEQ ID NO: 601 (IMGT) | HCDR2 | TYHRSTWYD |
| SEQ ID NO: 602 (IMGT) | HCDR3 | ARDRLQDGNSWSDAFDV |
| SEQ ID NO: 1006 (Combined Chothia and Kabat) | HCDR1 | GDSVLSNSDTWN |
| SEQ ID NO: 1007 (Combined Chothia and Kabat) | HCDR2 | RTYHRSTWYDDYASSVRG |
| SEQ ID NO: 1008 (Combined Chothia and Kabat) | HCDR3 | DRLQDGNSWSDAFDV |
| SEQ ID NO: 603 | VH | EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS |
| SEQ ID NO: 604 | DNA VH | GAAGTCCAATTGCAACAGTCCGGTCCTGGCCTCGTCAAGCCCTCCCAAACCCTCTCCCTGACTTGCGCCATCTCCGGGGATTCCGTGCTGAGCAACTCCGACACCTGGAACTGGATTCGGCAGAGCCCGTCCAGAGGCCTGGAGTGGCTGGGCAGGACCTACCACCGGAGCACTTGGTACGACGACTACGCCAGCTCCGTGCGCGGACGCGTGTCAATCAATGTGGACACCTCAAGAACCAGTACAGCCTGCAACTTAACGCTGTGACTCCCGAGGATACTGGAGTGTACTATTGTGCCCGCGACCGGCTGCAGGATGGAAACAGCTGGTCCGATGCCTTCGATGTCTGGGGACAGGGTACCATGGTCACAGTGTCCAGC |
| SEQ ID NO: 605 (Kabat) | LCDR1 | TGTSSDIGGYNYVS |
| SEQ ID NO: 606 (Kabat) | LCDR2 | EVSNRPS |
| SEQ ID NO: 607 (Kabat) | LCDR3 | SSYTSSSTLYV |
| SEQ ID NO: 608 (Chothia) | LCDR1 | TSSDIGGYNY |
| SEQ ID NO: 609 (Chothia) | LCDR2 | EVS |
| SEQ ID NO: 610 (Chothia) | LCDR3 | YTSSSTLY |
| SEQ ID NO: 611 (IMGT) | LCDR1 | SSDIGGYNY |
| SEQ ID NO: 612 (IMGT) | LCDR2 | EVS |
| SEQ ID NO: 613 (IMGT) | LCDR3 | SSYTSSSTLYV |
| SEQ ID NO: 1009 (Combined Chothia and Kabat) | LCDR1 | TGTSSDIGGYNYVS |

TABLE 6-continued

CD22 CAR Constructs

| SEQ ID NUMBER | Ab region | Sequence |
|---|---|---|
| SEQ ID NO: 1010 (Combined Chothia and Kabat) | LCDR2 | EVSNRPS |
| SEQ ID NO: 1011 (Combined Chothia and Kabat) | LCDR3 | SSYTSSSTLYV |
| SEQ ID NO: 614 | VL | QSALTQPASVSGSPGQSITFSCTGTSSDIGGYNYVS WYQQHPGKAPKLMIYEVSNRPSGVSNRFSGTKSG NTASLTISGLQAEDEADYYCSSYTSSSTLYVFGTGT KLTVL |
| SEQ ID NO: 615 | DNA VL | CAGTCCGCGCTGACCCAGCCCGCCTCTGTGTCCG GATCACCGGGACAGTCGATCACGTTTTCCTGCAC TGGCACCTCGTCCGACATCGGAGGTTACAACTAC GTGTCGTGGTACCAGCAGCATCCAGGAAAGGCC CCGAAGCTCATGATCTACGAAGTGTCAAACCGG CCTTCGGGGGTGTCAAACAGATTCTCGGGCACCA AGTCCGGAAATACCGCATCCCTGACCATTAGCG GCCTGCAGGCGGAGGACGAAGCCGACTACTATT GCTCCTCGTACACCTCGAGCTCCACTCTGTACGT GTTCGGCACTGGGACCAAACTTACCGTGCTC |
| SEQ ID NO: 616 | Linker | GGGGSGGGGSGSGGS |
| SEQ ID NO: 617 | scFv (VH-linker-VL) | EVQLQQSGPGLVKPSQTLSLTCAISGDSVLSNSDT WNWIRQSPSRGLEWLGRTYHRSTWYDDYASSVRG RVSINVDTSKNQYSLQLNAVTPEDTGVYYCARDRL QDGNSWSDAFDVWGQGTMVTVSSGGGGSGGGGS GSGGSQSALTQPASVSGSPGQSITFSCTGTSSDIGGY NYVSWYQQHPGKAPKLMIYEVSNRPSGVSNRFSG TKSGNTASLTISGLQAEDEADYYCSSYTSSSTLYVF GTGTKLTVL |
| SEQ ID NO: 618 | DNA scFv (VH-linker-VL) | GAAGTCCAATTGCAACAGTCCGGTCCTGGCCTCGTCA AGCCCTCCCAAACCCTCTCCCTGACTTGCGCCATCTC CGGGGATTCCGTGCTGAGCAACTCCGACACCTGGAA CTGGATTCGGCAGAGCCCGTCCAGAGGCCTGGAGTG GCTGGGCAGGACCTACCACCGGAGCACTTGGTACGA CGACTACGCCAGCTCCGTGCGCGGACGCGTGTCAATC AATGTGGACACCTCCAAGAACCAGTACAGCCTGCAA CTTAACGCTGTGACTCCCGAGGATACTGGAGTGTACT ATTGTGCCCGCGACCGGCTGCAGGATGGAAACAGCT GGTCCGATGCCTTCGATGTCTGGGGACAGGGTACCAT GGTCACAGTGTCCAGCGGGGGGGGCGGATCAGGCGG CGGTGGCTCCGGATCGGGGGGTTCCCAGTCCGCGCTG ACCCAGCCCGCCTCTGTGTCCGGATCACCGGGACAGT CGATCACGTTTTCCTGCACTGGCACCTCGTCCGACAT CGGAGGTTACAACTACGTGTCGTGGTACCAGCAGCAT CCAGGAAAGGCCCCGAAGCTCATGATCTACGAAGTG TCAAACCGGCCTTCGGGGGTGTCAAACAGATTCTCGG GCACCAAGTCCGGAAATACCGCATCCCTGACCATTAG CGGCCTGCAGGCGGAGGACGAAGCCGACTACTATTG CTCCTCGTACACCTCGAGCTCCACTCTGTACGTGTTC GGCACTGGGACCAAACTTACCGTGCTC |

CD22-61

| SEQ ID NO: 619 (Kabat) | HCDR1 | SNSDTWN |
|---|---|---|
| SEQ ID NO: 620 (Kabat) | HCDR2 | RTYHRSTWYDDYASSVRG |
| SEQ ID NO: 621 (Kabat) | HCDR3 | DRLQDGNSWSDAFDV |
| SEQ ID NO: 622 (Chothia) | HCDR1 | GDSVLSNSD |

TABLE 6-continued

CD22 CAR Constructs

| SEQ ID NUMBER | Ab region | Sequence |
|---|---|---|
| SEQ ID NO: 623 (Chothia) | HCDR2 | YHRSTWY |
| SEQ ID NO: 624 (Chothia) | HCDR3 | DRLQDGNSWSDAFDV |
| SEQ ID NO: 625 (IMGT) | HCDR1 | GDSVLSNSDT |
| SEQ ID NO: 626 (IMGT) | HCDR2 | TYHRSTWYD |
| SEQ ID NO: 627 (IMGT) | HCDR3 | ARDRLQDGNSWSDAFDV |
| SEQ ID NO: 1012 (Combined Chothia and Kabat) | HCDR1 | GDSVLSNSDTWN |
| SEQ ID NO: 1013 (Combined Chothia and Kabat) | HCDR2 | RTYHRSTWYDDYASSVRG |
| SEQ ID NO: 1014 (Combined Chothia and Kabat) | HCDR3 | DRLQDGNSWSDAFDV |
| SEQ ID NO: 628 | VH | QVQLQESGPGLVKPSQTLSLTCAISGDSVLSNSDT WNWIRQSPSRGLEWLGRTYHRSTWYDDYASSVRG RVSINVDTSKNQYSLQLNAVTPEDTGVYYCARDRL QDGNSWSDAFDVWGQGTMVTVSS |
| SEQ ID NO: 629 | DNA VH | CAAGTCCAATTGCAAGAATCCGGTCCTGGCCTCG TCAAGCCCTCCCAAACCCTCTCCCTGACTTGCGC CATCTCCGGGGATTCCGTGCTGAGCAACTCCGAC ACCTGGAACTGGATTCGGCAGAGCCCGTCCAGA GGCCTGGAGTGGCTGGGCAGGACCTACCACCGG AGCACTTGGTACGACGACTACGCCAGCTCCGTGC GCGGACGCGTGTCAATCAATGTGGACACCTCCA AGAACCAGTACAGCCTGCAACTTAACGCTGTGA CTCCCGAGGATACTGGAGTGTACTATTGTGCCCG CGACCGGCTGCAGGATGGAAACAGCTGGTCCGA TGCCTTCGATGTCTGGGGACAGGGTACCATGGTC ACAGTGTCCAGC |
| SEQ ID NO: 630 (Kabat) | LCDR1 | TGTSSDVGGYNYVS |
| SEQ ID NO: 631 (Kabat) | LCDR2 | EVSNRPS |
| SEQ ID NO: 632 (Kabat) | LCDR3 | SSYTSSSTLYV |
| SEQ ID NO: 633 (Chothia) | LCDR1 | TSSDVGGYNY |
| SEQ ID NO: 634 (Chothia) | LCDR2 | EVS |
| SEQ ID NO: 635 (Chothia) | LCDR3 | YTSSSTLY |
| SEQ ID NO: 636 (IMGT) | LCDR1 | SSDVGGYNY |
| SEQ ID NO: 637 (IMGT) | LCDR2 | EVS |
| SEQ ID NO: 638 (IMGT) | LCDR3 | SSYTSSSTLYV |

TABLE 6-continued

CD22 CAR Constructs

| SEQ ID NUMBER | Ab region | Sequence |
| --- | --- | --- |
| SEQ ID NO: 1015 (Combined Chothia and Kabat) | LCDR1 | TGTSSDVGGYNYVS |
| SEQ ID NO: 1016 (Combined Chothia and Kabat) | LCDR2 | EVSNRPS |
| SEQ ID NO: 1017 (Combined Chothia and Kabat) | LCDR3 | SSYTSSSTLYV |
| SEQ ID NO: 639 | VL | QSALTQPASVSGSPGQSITISCTGTSSDVGGYNYVS WYQQHPGKAPKLMIYEVSNRPSGVSNRFSGSKSG NTASLTISGLQAEDEADYYCSSYTSSSTLYVFGTGT KVTVL |
| SEQ ID NO: 640 | DNA VL | CAGTCCGCGCTGACCCAGCCCGCCTCTGTGTCCG GATCACCGGGACAGTCGATCACGATCTCCTGCAC TGGCACCTCGTCCGACGTGGGAGGTTACAACTAC GTGTCGTGGTACCAGCAGCATCCAGGAAAGGCC CCGAAGCTCATGATCTACGAAGTGTCAAACCGG CCTTCGGGGGTGTCAAACAGATTCTCGGGCTCCA AGTCCGGAAATACCGCATCCCTGACCATTAGCG GCCTGCAGGCGGAGGACGAAGCCGACTACTATT GCTCCTCGTACACCTCGAGCTCCACTCTGTACGT GTTCGGCACTGGGACCAAAGTCACCGTGCTC |
| SEQ ID NO: 641 | Linker | GGGGSGGGGSGSGGS |
| SEQ ID NO: 642 | scFv (VH-linker-VL) | QVQLQESGPGLVKPSQTLSLTCAISGDSVLSNSDT WNWIRQSPSRGLEWLGRTYHRSTWYDDYASSVRG RVSINVDTSKNQYSLQLNAVTPEDTGVYYCARDRL QDGNSWSDAFDVWGQGTMVTVSSGGGGSGGGGS GSGGSQSALTQPASVSGSPGQSITISCTGTSSDVGG YNYVSWYQQHPGKAPKLMIYEVSNRPSGVSNRFS GSKSGNTASLTISGLQAEDEADYYCSSYTSSSTLYV FGTGTKVTVL |
| SEQ ID NO: 643 | DNA scFv (VH-linker-VL) | CAAGTCCAATTGCAAGAATCCGGTCCTGGCCTCGTCA AGCCCTCCCAAACCCTCTCCCTGACTTGCGCCATCTC CGGGGATTCCGTGCTGAGCAACTCCGACACCTGGAA CTGGATTCGGCAGAGCCCGTCCAGAGGCCTGGAGTG GCTGGGCAGGACCTACCACCGGAGCACTTGGTACGA CGACTACGCCAGCTCCGTGCGCGGACGCGTGTCAATC AATGTGGACACCTCCAAGAACCAGTACAGCCTGCAA CTTAACGCTGTGACTCCCGAGGATACTGGAGTGTACT ATTGTGCCCGCGACCGGCTGCAGGATGGAAACAGCT GGTCCGATGCCTTCGATGTCTGGGGACAGGGTACCAT GGTCACAGTGTCCAGCGGGGGGGGCGGATCAGGCGG CGGTGGCTCCGGATCGGGGGGTTCCCAGTCCGCGCTG ACCCAGCCCGCCTCTGTGTCCGGATCACCGGGACAGT CGATCACGATCTCCTGCACTGGCACCTCGTCCGACGT GGGAGGTTACAACTACGTGTCGTGGTACCAGCAGCA TCCAGGAAAGGCCCCGAAGCTCATGATCTACGAAGT GTCAAACCGGCCTTCGGGGGTGTCAAACAGATTCTCG GGCTCCAAGTCCGGAAATACCGCATCCCTGACCATTA GCGGCCTGCAGGCGGAGGACGAAGCCGACTACTATT GCTCCTCGTACACCTCGAGCTCCACTCTGTACGTGTT CGGCACTGGGACCAAAGTCACCGTGCTC |

CD22-62

| SEQ ID NO: 644 (Kabat) | HCDR1 | SNSDTWN |
| --- | --- | --- |
| SEQ ID NO: 645 (Kabat) | HCDR2 | RTYHRSTWYDDYASSVRG |

TABLE 6-continued

CD22 CAR Constructs

| SEQ ID NUMBER | Ab region | Sequence |
|---|---|---|
| SEQ ID NO: 646 (Kabat) | HCDR3 | DRLQDGNSWSDAFDV |
| SEQ ID NO: 647 (Chothia) | HCDR1 | GDSVLSNSD |
| SEQ ID NO: 648 (Chothia) | HCDR2 | YHRSTWY |
| SEQ ID NO: 649 (Chothia) | HCDR3 | DRLQDGNSWSDAFDV |
| SEQ ID NO: 650 (IMGT) | HCDR1 | GDSVLSNSDT |
| SEQ ID NO: 651 (IMGT) | HCDR2 | TYHRSTWYD |
| SEQ ID NO: 652 (IMGT) | HCDR3 | ARDRLQDGNSWSDAFDV |
| SEQ ID NO: 1018 (Combined Chothia and Kabat) | HCDR1 | GDSVLSNSDTWN |
| SEQ ID NO: 1019 (Combined Chothia and Kabat) | HCDR2 | RTYHRSTWYDDYASSVRG |
| SEQ ID NO: 1020 (Combined Chothia and Kabat) | HCDR3 | DRLQDGNSWSDAFDV |
| SEQ ID NO: 653 | VH | EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS |
| SEQ ID NO: 654 | DNA VH | GAAGTCCAATTGCAACAGTCCGGTCCTGGCCTCGTCAAGCCCTCCCAAACCCTCTCCCTGACTTGCGCCATCTCCGGGGATTCCGTGCTGAGCAACTCCGACACCTGGAACTGGATTCGGCAGAGCCCGTCCAGAGGCCTGGAGTGGCTGGGCAGGACCTACCACCGGAGCACTTGGTACGACGACTACGCCAGCTCCGTGCGCGGACGCGTGTCAATCAATGTGGACACCTCCAAGAACCAGTACAGCCTGCAACTTAACGCTGTGACTCCCGAGGATACTGGAGTGTACTATTGTGCCCGCGACCGGCTGCAGGATGGAAACAGCTGGTCCGATGCCTTCGATGTCTGGGGACAGGGTACCATGGTCACAGTGTCCAGC |
| SEQ ID NO: 655 (Kabat) | LCDR1 | TGTSSDVGGYNYVS |
| SEQ ID NO: 656 (Kabat) | LCDR2 | DVSNRPS |
| SEQ ID NO: 657 (Kabat) | LCDR3 | SSYTSSSTLYV |
| SEQ ID NO: 658 (Chothia) | LCDR1 | TSSDVGGYNY |
| SEQ ID NO: 659 (Chothia) | LCDR2 | DVS |
| SEQ ID NO: 660 (Chothia) | LCDR3 | YTSSSTLY |
| SEQ ID NO: 661 (IMGT) | LCDR1 | SSDVGGYNY |

TABLE 6-continued

CD22 CAR Constructs

| SEQ ID NUMBER | Ab region | Sequence |
|---|---|---|
| SEQ ID NO: 662 (IMGT) | LCDR2 | DVS |
| SEQ ID NO: 663 (IMGT) | LCDR3 | SSYTSSSTLYV |
| SEQ ID NO: 1021 (Combined Chothia and Kabat) | LCDR1 | TGTSSDVGGYNYVS |
| SEQ ID NO: 1022 (Combined Chothia and Kabat) | LCDR2 | DVSNRPS |
| SEQ ID NO: 1023 (Combined Chothia and Kabat) | LCDR3 | SSYTSSSTLYV |
| SEQ ID NO: 664 | VL | QSALTQPASVSGSPGQSITISCTGTSSDVGGYNYVS WYQQHPGKAPKLMIYDVSNRPSGVSNRFSGSKSG NTASLTISGLQAEDEADYYCSSYTSSSTLYVFGTGT KVTVL |
| SEQ ID NO: 665 | DNA VL | CAGTCCGCGCTGACCCAGCCCGCCTCTGTGTCCG GATCACCGGGACAGTCGATCACGATCTCCTGCAC TGGCACCTCGTCCGACGTGGGAGGTTACAACTAC GTGTCGTGGTACCAGCAGCATCCAGGAAAGGCC CCGAAGCTCATGATCTACGACGTGTCAAACCGG CCTTCGGGGGTGTCAAACAGATTCTCGGGCTCCA AGTCCGGAAATACCGCATCCCTGACCATTAGCG GCCTGCAGGCGGAGGACGAAGCCGACTACTATT GCTCCTCGTACACCTCGAGCTCCACTCTGTACGT GTTCGGCACTGGGACCAAAGTCACCGTGCTC |
| SEQ ID NO: 666 | Linker | GGGGSGGGGSGGGGS |
| SEQ ID NO: 667 | scFv (VH-linker-VL) | EVQLQQSGPGLVKPSQTLSLTCAISGDSVLSNSDT WNWIRQSPSRGLEWLGRTYHRSTWYDDYASSVRG RVSINVDTSKNQYSLQLNAVTPEDTGVYYCARDRL QDGNSWSDAFDVWQGTMVTVSSGGGGSGGGGS GGGGSQSALTQPASVSGSPGQSITISCTGTSSDVGG YNYVSWYQQHPGKAPKLMIYDVSNRPSGVSNRFS GSKSGNTASLTISGLQAEDEADYYCSSYTSSSTLYV FGTGTKVTVL |
| SEQ ID NO: 668 | DNA scFv (VH-linker-VL) | GAAGTCCAATTGCAACAGTCCGGTCCTGGCCTCGTCA AGCCCTCCCAAACCCTCTCCCTGACTTGCGCCATCTC CGGGGATTCCGTGCTGAGCAACTCCGACACCTGGAA CTGGATTCGGCAGAGCCCGTCCAGAGGCCTGGAGTG GCTGGGCAGGACCTACCACCGGAGCACTTGGTACGA CGACTACGCCAGCTCCGTGCGCGGACGCGTGTCAATC AATGTGGACACCTCCAAGAACCAGTACAGCCTGCAA CTTAACGCTGTGACTCCCGAGGATACTGGAGTGTACT ATTGTGCCCGCGACCGGCTGCAGGATGGAAACAGCT GGTCCGATGCCTTCGATGTCTGGGGACAGGGTACCAT GGTCACAGTGTCCAGCGGGGGGGGCGGATCAGGCGG CGGTGGCTCCGGAGGAGGGGGTTCCCAGTCCGCGCT GACCCAGCCCGCCTCTGTGTCCGGATCACCGGGACAG TCGATCACGATCTCCTGCACTGGCACCTCGTCCGACG TGGGAGGTTACAACTACGTGTCGTGGTACCAGCAGC ATCCAGGAAAGGCCCCGAAGCTCATGATCTACGACG TGTCAAACCGGCCTTCGGGGGTGTCAAACAGATTCTC GGGCTCCAAGTCCGGAAATACCGCATCCCTGACCATT AGCGGCCTGCAGGCGGAGGACGAAGCCGACTACTAT TGCTCCTCGTACACCTCGAGCTCCACTCTGTACGTGTT CGGCACTGGGACCAAAGTCACCGTGCTC |

TABLE 6-continued

| | CD22 CAR Constructs | |
|---|---|---|
| SEQ ID NUMBER | Ab region | Sequence |
| CD22-63 | | |
| SEQ ID NO: 669 (Kabat) | HCDR1 | SNSDTWN |
| SEQ ID NO: 670 (Kabat) | HCDR2 | RTYHRSTWYDDYASSVRG |
| SEQ ID NO: 671 (Kabat) | HCDR3 | DRLQDGNSWSDAFDV |
| SEQ ID NO: 672 (Chothia) | HCDR1 | GDSVLSNSD |
| SEQ ID NO: 673 (Chothia) | HCDR2 | YHRSTWY |
| SEQ ID NO: 674 (Chothia) | HCDR3 | DRLQDGNSWSDAFDV |
| SEQ ID NO: 675 (IMGT) | HCDR1 | GDSVLSNSDT |
| SEQ ID NO: 676 (IMGT) | HCDR2 | TYHRSTWYD |
| SEQ ID NO: 677 (IMGT) | HCDR3 | ARDRLQDGNSWSDAFDV |
| SEQ ID NO: 1024 (Combined Chothia and Kabat) | HCDR1 | GDSVLSNSDTWN |
| SEQ ID NO: 1025 (Combined Chothia and Kabat) | HCDR2 | RTYHRSTWYDDYASSVRG |
| SEQ ID NO: 1026 (Combined Chothia and Kabat) | HCDR3 | DRLQDGNSWSDAFDV |
| SEQ ID NO: 678 | VH | EVQLQQSGPGLVKPSQTLSLTCAISGDSVLSNSDT WNWIRQSPSRGLEWLGRTYHRSTWYDDYASSVRG RVSINVDTSKNQYSLQLNAVTPEDTGVYYCARDRL QDGNSWSDAFDVWGQGTMVTVSS |
| SEQ ID NO: 679 | DNA VH | GAAGTCCAATTGCAACAGTCCGGTCCTGGCCTCG TCAAGCCCTCCCAAACCCTCTCCCTGACTTGCGC CATCTCCGGGGATTCCGTGCTGAGCAACTCCGAC ACCTGGAACTGGATTCGGCAGAGCCCGTCCAGA GGCCTGGAGTGGCTGGGCAGGACCTACCACCGG AGCACTTGGTACGACGACTACGCCAGCTCCGTGC GCGGACGCGTGTCAATCAATGTGGACACCTCCA AGAACCAGTACAGCCTGCAACTTAACGCTGTGA CTCCCGAGGATACTGGAGTGTACTATTGTGCCCG CGACCGGCTGCAGGATGGAAACAGCTGGTCCGA TGCCTTCGATGTCTGGGGACAGGGTACCATGGTC ACAGTGTCCAGC |
| SEQ ID NO: 680 (Kabat) | LCDR1 | TGTSSDVGGYNYVS |
| SEQ ID NO: 681 (Kabat) | LCDR2 | EVSNRPS |
| SEQ ID NO: 682 (Kabat) | LCDR3 | SSYTSSSTLYI |
| SEQ ID NO: 683 (Chothia) | LCDR1 | TSSDVGGYNY |

TABLE 6-continued

| | CD22 CAR Constructs | |
|---|---|---|
| SEQ ID NUMBER | Ab region | Sequence |
| SEQ ID NO: 684 (Chothia) | LCDR2 | EVS |
| SEQ ID NO: 685 (Chothia) | LCDR3 | YTSSSTLY |
| SEQ ID NO: 686 (IMGT) | LCDR1 | SSDVGGYNY |
| SEQ ID NO: 687 (IMGT) | LCDR2 | EVS |
| SEQ ID NO: 688 (IMGT) | LCDR3 | SSYTSSSTLYI |
| SEQ ID NO: 1027 (Combined Chothia and Kabat) | LCDR1 | TGTSSDVGGYNYVS |
| SEQ ID NO: 1028 (Combined Chothia and Kabat) | LCDR2 | EVSNRPS |
| SEQ ID NO: 1029 (Combined Chothia and Kabat) | LCDR3 | SSYTSSSTLYI |
| SEQ ID NO: 689 | VL | QSALTQPASVSGSPGQSITISCTGTSSDVGGYNYVS WYQQHPGKAPKLMIYEVSNRPSGVSNRFSGSKSG NTASLTISGLQAEDEADYYCSSYTSSSTLYIFGTGT KVTVL |
| SEQ ID NO: 690 | DNA VL | CAGTCCGCGCTGACCCAGCCCGCCTCTGTGTCCG GATCACCGGGACAGTCGATCACGATCTCCTGCAC TGGCACCTCGTCCGACGTGGGAGGTTACAACTAC GTGTCGTGGTACCAGCAGCATCCAGGAAAGGCC CCGAAGCTCATGATCTACGAAGTGTCAAACCGG CCTTCGGGGGTGTCAAACAGATTCTCGGGCTCCA AGTCCGGAAATACCGCATCCCTGACCATTAGCG GCCTGCAGGCGGAGGACGAAGCCGACTACTATT GCTCCTCGTACACCTCGAGCTCCACTCTGTACAT TTTCGGCACTGGGACCAAAGTCACCGTGCTC |
| SEQ ID NO: 691 | Linker | GGGGSGGGGSGGGGS |
| SEQ ID NO: 692 | scFv (VH-linker-VL) | EVQLQQSGPGLVKPSQTLSLTCAISGDSVLSNSDT WNWIRQSPSRGLEWLGRTYHRSTWYDDYASSVRG RVSINVDTSKNQYSLQLNAVTPEDTGVYYCARDRL QDGNSWSDAFDVWGQGTMVTVSSGGGGSGGGGS GGGGSQSALTQPASVSGSPGQSITISCTGTSSDVGG YNYVSWYQQHPGKAPKLMIYEVSNRPSGVSNRFS GSKSGNTASLTISGLQAEDEADYYCSSYTSSSTLYIF GTGTKVTVL |
| SEQ ID NO: 693 | DNA scFv (VH-linker-VL) | GAAGTCCAATTGCAACAGTCCGGTCCTGGCCTCGTCA AGCCCTCCCAAACCCTCTCCCTGACTTGCGCCATCTC CGGGGATTCCGTGCTGAGCAACTCCGACACCTGGAA CTGGATTCGGCAGAGCCCGTCCAGAGGCCTGGAGTG GCTGGGCAGGACCTACCACCGGAGCACTTGGTACGA CGACTACGCCAGCTCCGTGCGCGGACGCGTGTCAATC AATGTGGACACCTCCAAGAACCAGTACAGCCTGCAA CTTAACGCTGTGACTCCCGAGGATACTGGAGTGTACT ATTGTGCCCGCGACCGGCTGCAGGATGGAAACAGCT GGTCCGATGCCTTCGATGTCTGGGGACAGGGTACCAT GGTCACAGTGTCCAGCGGGGGGGGCGGATCAGGCGG CGGTGGCTCCGGAGGAGGGGGTTCCCAGTCCGCGCT GACCCAGCCCGCCTCTGTGTCCGGATCACCGGGACAG TCGATCACGATCTCCTGCACTGGCACCTCGTCCGACG TGGGAGGTTACAACTACGTGTCGTGGTACCAGCAGC ATCCAGGAAAGGCCCCGAAGCTCATGATCTACGAAG |

TABLE 6-continued

CD22 CAR Constructs

| SEQ ID NUMBER | Ab region | Sequence |
|---|---|---|
| | | TGTCAAACCGGCCTTCGGGGGTGTCAAACAGATTCTC GGGCTCCAAGTCCGGAAATACCGCATCCCTGACCATT AGCGGCCTGCAGGCGGAGGACGAAGCCGACTACTAT TGCTCCTCGTACACCTCGAGCTCCACTCTGTACATTTT CGGCACTGGGACCAAAGTCACCGTGCTC |

CD22-64

| SEQ ID NO: 694 (Kabat) | HCDR1 | SNSDTWN |
| --- | --- | --- |
| SEQ ID NO: 695 (Kabat) | HCDR2 | RTYHRSTWYDDYASSVRG |
| SEQ ID NO: 696 (Kabat) | HCDR3 | VRLQDGNSWSDAFDV |
| SEQ ID NO: 697 (Chothia) | HCDR1 | GDSVLSNSD |
| SEQ ID NO: 698 (Chothia) | HCDR2 | YHRSTWY |
| SEQ ID NO: 699 (Chothia) | HCDR3 | VRLQDGNSWSDAFDV |
| SEQ ID NO: 700 (IMGT) | HCDR1 | GDSVLSNSDT |
| SEQ ID NO: 701 (IMGT) | HCDR2 | TYHRSTWYD |
| SEQ ID NO: 702 (IMGT) | HCDR3 | ARVRLQDGNSWSDAFDV |
| SEQ ID NO: 1030 (Combined Chothia and Kabat) | HCDR1 | GDSVLSNSDTWN |
| SEQ ID NO: 1031 (Combined Chothia and Kabat) | HCDR2 | RTYHRSTWYDDYASSVRG |
| SEQ ID NO: 1032 (Combined Chothia and Kabat) | HCDR3 | VRLQDGNSWSDAFDV |
| SEQ ID NO: 703 | VH | EVQLQQSGPGLVKPSQTLPLTCAISGDSVLSNSDT WNWIRQSPSRGLEWLGRTYHRSTWYDDYASSVRG RVSINVDTSKNQYSLQLNAVTPEDTGVYYCARVRL QDGNSWSDAFDVWGQGTMVTVSS |
| SEQ ID NO: 704 | DNA VH | GAAGTGCAGCTTCAACAATCAGGACCCGGACTC GTCAAACCATCGCAGACCCTCCCTCTCACTTGCG CCATCTCCGGGGACTCCGTGCTGTCCAACTCCGA CACTTGGAACTGGATTCGGCAGAGCCCGTCCAG AGGATTGGAATGGCTGGGAAGGACCTATCACCG GTCCACTTGGTACGACGATTACGCCTCGTCCGTG CGCGGTCGGGTGTCCATCAACGTGGACACCTCCA AGAACCAGTACTCCCTGCAACTGAACGCCGTGA CCCCTGAGGACACTGGGGTGTACTACTGTGCGA GAGTGCGGCTGCAGGATGGGAACTCTTGGTCCG ACGCCTTCGATGTCTGGGGCCAGGGCACCATGGT CACTGTGTCATCC |
| SEQ ID NO: 705 (Kabat) | LCDR1 | TGTSSDVGGYNYVS |
| SEQ ID NO: 706 (Kabat) | LCDR2 | DVSNRPS |

TABLE 6-continued

CD22 CAR Constructs

| SEQ ID NUMBER | Ab region | Sequence |
| --- | --- | --- |
| SEQ ID NO: 707 (Kabat) | LCDR3 | SSYTSSSTLYV |
| SEQ ID NO: 708 (Chothia) | LCDR1 | TSSDVGGYNY |
| SEQ ID NO: 709 (Chothia) | LCDR2 | DVS |
| SEQ ID NO: 710 (Chothia) | LCDR3 | YTSSSTLY |
| SEQ ID NO: 711 (IMGT) | LCDR1 | SSDVGGYNY |
| SEQ ID NO: 712 (IMGT) | LCDR2 | DVS |
| SEQ ID NO: 713 (IMGT) | LCDR3 | SSYTSSSTLYV |
| SEQ ID NO: 1033 (Combined Chothia and Kabat) | LCDR1 | TGTSSDVGGYNYVS |
| SEQ ID NO: 1034 (Combined Chothia and Kabat) | LCDR2 | DVSNRPS |
| SEQ ID NO: 1035 (Combined Chothia and Kabat) | LCDR3 | SSYTSSSTLYV |
| SEQ ID NO: 714 | VL | QSALTQPASASGSPGQSVTISCTGTSSDVGGYNYVS WYQQHPGKAPKLMIYDVSNRPSGVSNRFSGSKSG NTASLTISGLQAEDEADYYCSSYTSSSTLYVFGTGT QLTVL |
| SEQ ID NO: 715 | DNA VL | CAGTCGGCACTGACCCAGCCTGCCTCAGCCTCCG GGAGCCCGGGACAGTCCGTGACCATTTCCTGCAC CGGGACCTCCTCCGACGTGGGAGGCTACAACTA CGTGTCATGGTACCAGCAGCACCCCGGAAAGGC ACCGAAGCTGATGATCTACGACGTGTCCAACCG CCCGAGCGGGGTGTCAAATCGCTTCTCGGGCTCG AAGTCGGGAAACACAGCGAGCCTGACGATCTCG GGACTGCAAGCCGAAGATGAGGCTGACTACTAC TGCTCGTCCTACACTAGCTCCAGCACCCTCTACG TGTTCGGTACTGGTACCCAGCTGACCGTCCTG |
| SEQ ID NO: 716 | Linker | GGGGSGGGGSGGGGP |
| SEQ ID NO: 717 | scFv (VH-linker-VL) | EVQLQQSGPGLVKPSQTLPLTCAISGDSVLSNSDT WNWIRQSPSRGLEWLGRTYHRSTWYDDYASSVRG RVSINVDTSKNQYSLQLNAVTPEDTGVYYCARVRL QDGNSWSDAFDVWGQGTMVTVSSGGGGSGGGGS GGGGPQSALTQPASASGSPGQSVTISCTGTSSDVGG YNYVSWYQQHPGKAPKLMIYDVSNRPSGVSNRFS GSKSGNTASLTISGLQAEDEADYYCSSYTSSSTLYV FGTGTQLTVL |
| SEQ ID NO: 718 | DNA scFv (VH-linker-VL) | GAAGTGCAGCTTCAACAATCAGGACCCGGACTCGTC AAACCATCGCAGACCCTCCCTCTCACTTGCGCCATCT CCGGGGACTCCGTGCTGTCCAACTCCGACACTTGGAA CTGGATTCGGCAGAGCCCGTCCAGAGGATTGGAATG GCTGGGAAGGACCTATCACCGGTCCACTTGGTACGAC GATTACGCCTCGTCCGTGCGCGGTCGGGTGTCCATCA ACGTGGACACCTCCAAGAACCAGTACTCCCTGCAACT GAACGCCGTGACCCCTGAGGACACTGGGGTGTACTA CTGTGCGAGAGTGCGGCTGCAGGATGGGAACTCTTG GTCCGACGCCTTCGATGTCTGGGGCCAGGGCACCATG |

TABLE 6-continued

CD22 CAR Constructs

| SEQ ID NUMBER | Ab region | Sequence |
|---|---|---|
| | | GTCACTGTGTCATCCGGCGGTGGTGGCAGCGGCGGA<br>GGCGGCAGCGGAGGCGGAGGACCCCAGTCGGCACTG<br>ACCCAGCCTGCCTCAGCCTCCGGGAGCCCGGGACAG<br>TCCGTGACCATTTCCTGCACCGGGACCTCCTCCGACG<br>TGGGAGGCTACAACTACGTGTCATGGTACCAGCAGC<br>ACCCCGGAAAGGCACCGAAGCTGATGATCTACGACG<br>TGTCCAACCGCCCGAGCGGGGTGTCAAATCGCTTCTC<br>GGGCTCGAAGTCGGGAAACACAGCGAGCCTGACGAT<br>CTCGGGACTGCAAGCCGAAGATGAGGCTGACTACTA<br>CTGCTCGTCCTACACTAGCTCCAGCACCCTCTACGTG<br>TTCGGTACTGGTACCCAGCTGACCGTCCTG |

CD22-65

| SEQ ID NO: 719 (Kabat) | HCDR1 | SNSDTWN |
| SEQ ID NO: 720 (Kabat) | HCDR2 | RTYHRSTWYDDYASSVRG |
| SEQ ID NO: 721 (Kabat) | HCDR3 | VRLQDGNSWSDAFDV |
| SEQ ID NO: 722 (Chothia) | HCDR1 | GDSMLSNSD |
| SEQ ID NO: 723 (Chothia) | HCDR2 | YHRSTWY |
| SEQ ID NO: 724 (Chothia) | HCDR3 | VRLQDGNSWSDAFDV |
| SEQ ID NO: 725 (IMGT) | HCDR1 | GDSMLSNSDT |
| SEQ ID NO: 726 (IMGT) | HCDR2 | TYHRSTWYD |
| SEQ ID NO: 727 (IMGT) | HCDR3 | ARVRLQDGNSWSDAFDV |
| SEQ ID NO: 1036 (Combined Chothia and Kabat) | HCDR1 | GDSMLSNSDTWN |
| SEQ ID NO: 1037 (Combined Chothia and Kabat) | HCDR2 | RTYHRSTWYDDYASSVRG |
| SEQ ID NO: 1038 (Combined Chothia and Kabat) | HCDR3 | VRLQDGNSWSDAFDV |
| SEQ ID NO: 728 | VH | EVQLQQSGPGLVKPSQTLSLTCAISGDSMLSNSDT<br>WNWIRQSPSRGLEWLGRTYHRSTWYDDYASSVRG<br>RVSINVDTSKNQYSLQLNAVTPEDTGVYYCARVRL<br>QDGNSWSDAFDVWGQGTMVTVSS |
| SEQ ID NO: 729 | DNA VH | GAAGTGCAGCTTCAACAATCAGGACCCGGACTC<br>GTCAAACCATCGCAGACCCTCAGCCTCACTTGCG<br>CCATCTCCGGGGACTCCATGCTGTCCAACTCCGA<br>CACTTGGAACTGGATTCGGCAGAGCCCGTCCAG<br>AGGATTGGAATGGCTGGGAAGGACCTATCACCG<br>GTCCACTTGGTACGACGATTACGCCTCGTCCGTG<br>CGCGGTCGGGTGTCCATCAACGTGGACACCTCCA<br>AGAACCAGTACTCCCTGCAACTGAACGCCGTGA<br>CCCCTGAGGACACTGGGGTGTACTACTGTGCGA<br>GAGTGCGGCTGCAGGATGGGAACTCTTGGTCCG<br>ACGCCTTCGATGTCTGGGGCCAGGGCACCATGGT<br>CACTGTGTCATCC |

TABLE 6-continued

CD22 CAR Constructs

| SEQ ID NUMBER | Ab region | Sequence |
|---|---|---|
| SEQ ID NO: 730 (Kabat) | LCDR1 | TGTSSDVGGYNYVS |
| SEQ ID NO: 731 (Kabat) | LCDR2 | DVSNRPS |
| SEQ ID NO: 732 (Kabat) | LCDR3 | SSYTSSSTLYV |
| SEQ ID NO: 733 (Chothia) | LCDR1 | TSSDVGGYNY |
| SEQ ID NO: 734 (Chothia) | LCDR2 | DVS |
| SEQ ID NO: 735 (Chothia) | LCDR3 | YTSSSTLY |
| SEQ ID NO: 736 (IMGT) | LCDR1 | SSDVGGYNY |
| SEQ ID NO: 737 (IMGT) | LCDR2 | DVS |
| SEQ ID NO: 738 (IMGT) | LCDR3 | SSYTSSSTLYV |
| SEQ ID NO: 1039 (Combined Chothia and Kabat) | LCDR1 | TGTSSDVGGYNYVS |
| SEQ ID NO: 1040 (Combined Chothia and Kabat) | LCDR2 | DVSNRPS |
| SEQ ID NO: 1041 (Combined Chothia and Kabat) | LCDR3 | SSYTSSSTLYV |
| SEQ ID NO: 739 | VL | QSALTQPASASGSPGQSVTISCTGTSSDVGGYNYVS WYQQHPGKAPKLMIYDVSNRPSGVSNRFSGSKSG NTASLTISGLQAEDEADYYCSSYTSSSTLYVFGTGT QLTVL |
| SEQ ID NO: 740 | DNA VL | CAGTCGGCACTGACCCAGCCTGCCTCAGCCTCCG GGAGCCCGGGACAGTCCGTGACCATTTCCTGCAC CGGGACCTCCTCCGACGTGGGAGGCTACAACTA CGTGTCATGGTACCAGCAGCACCCCGGAAAGGC ACCGAAGCTGATGATCTACGACGTGTCCAACCG CCCGAGCGGGGTGTCAAATCGCTTCTCGGGCTCG AAGTCGGGAAACACAGCGAGCCTGACGATCTCG GGACTGCAAGCCGAAGATGAGGCTGACTACTAC TGCTCGTCCTACACTAGCTCCAGCACCCTCTACG TGTTCGGTACTGGTACCCAGCTGACCGTCCTG |
| SEQ ID NO: 741 | Linker | GGGGSGGGGSGGGGS |
| SEQ ID NO: 742 | scFv (VH-linker-VL) | EVQLQQSGPGLVKPSQTLSLTCAISGDSMLSNSDT WNWIRQSPSRGLEWLGRTYHRSTWYDDYASSVRG RVSINVDTSKNQYSLQLNAVTPEDTGVYYCARVRL QDGNSWSDAFDVWGQGTMVTVSSGGGGSGGGGS GGGGSQSALTQPASASGSPGQSVTISCTGTSSDVGG YNYVSWYQQHPGKAPKLMIYDVSNRPSGVSNRFS GSKSGNTASLTISGLQAEDEADYYCSSYTSSSTLYV FGTGTQLTVL |
| SEQ ID NO: 743 | DNA scFv (VH-linker-VL) | GAAGTGCAGCTTCAACAATCAGGACCCGGACTCGTC AAACCATCGCAGACCCTCAGCCTCACTTGCGCCATCT CCGGGGACTCCATGCTGTCCAACTCCGACACTTGGAA CTGGATTCGGCAGAGCCCGTCCAGAGGATTGGAATG |

TABLE 6-continued

CD22 CAR Constructs

| SEQ ID NUMBER | Ab region | Sequence |
|---|---|---|
|  |  | GCTGGGAAGGACCTATCACCGGTCCACTTGGTACGAC<br>GATTACGCCTCGTCCGTGCGCGGTCGGGTGTCCATCA<br>ACGTGGACACCTCCAAGAACCAGTACTCCCTGCAACT<br>GAACGCCGTGACCCCTGAGGACACTGGGGTGTACTA<br>CTGTGCGAGAGTGCGGCTGCAGGATGGGAACTCTTG<br>GTCCGACGCCTTCGATGTCTGGGGCCAGGGCACCATG<br>GTCACTGTGTCATCCGGCGGTGGTGGCAGCGGCGGA<br>GGCGGCAGCGGAGGCGGAGGAAGCCAGTCGGCACTG<br>ACCCAGCCTGCCTCAGCCTCCGGGAGCCCGGGACAG<br>TCCGTGACCATTTCCTGCACCGGGACCTCCTCCGACG<br>TGGGAGGCTACAACTACGTGTCATGGTACCAGCAGC<br>ACCCCGGAAAGGCACCGAAGCTGATGATCTACGACG<br>TGTCCAACCGCCCGAGCGGGGTGTCAAATCGCTTCTC<br>GGGCTCGAAGTCGGGAAACACAGCGAGCCTGACGAT<br>CTCGGGACTGCAAGCCGAAGATGAGGCTGACTACTA<br>CTGCTCGTCCTACACTAGCTCCAGCACCCTCTACGTG<br>TTCGGTACTGGTACCCAGCTGACCGTCCTG |
| SEQ ID NO: 744 | Full amino acid sequence | MALPVTALLLPLALLLHAARPEVQLQQSGPGLVKP<br>SQTLSLTCAISGDSMLSNSDTWNWIRQSPSRGLEW<br>LGRTYHRSTWYDDYASSVRGRVSINVDTSKNQYS<br>LQLNAVTPEDTGVYYCARVRLQDGNSWSDAFDV<br>WGQGTMVTVSSGGGGSGGGGSGGGGSQSALTQP<br>ASASGSPGQSVTISCTGTSSDVGGYNYVSWYQQHP<br>GKAPKLMIYDVSNRPSGVSNRFSGSKSGNTASLTIS<br>GLQAEDEADYYCSSYTSSSTLYVFGTGTQLTVLTT<br>TPAPRPPTPAPTIASQPLSLRPEACRPAAGGAVHTR<br>GLDFACDIYIWAPLAGTCGVLLLSLVITLYCKRGR<br>KKLLYIFKQPFMRPVQTTQEEDGCSCRFPEEEEGGC<br>ELRVKFSRSADAPAYKQGQNQLYNELNLGRREEY<br>DVLDKRRGRDPEMGGKPRRKNPQEGLYNELQKD<br>KMAEAYSEIGMKGERRRGKGHDGLYQGLSTATKD<br>TYDALHMQALPPR |
| SEQ ID NO: 745 | Full nucleic acid sequence | ATGGCCCTCCCTGTCACCGCCCTGCTGCTTCCGC<br>TGGCTCTTCTGCTCCACGCCGCTCGGCCCGAAGT<br>GCAGCTTCAACAATCAGGACCCGGACTCGTCAA<br>ACCATCGCAGACCCTCAGCCTCACTTGCGCCATC<br>TCCGGGGACTCCATGCTGTCCAACTCCGACACTT<br>GGAACTGGATTCGGCAGAGCCCGTCCAGAGGAT<br>TGGAATGGCTGGGAAGGACCTATCACCGGTCCA<br>CTTGGTACGACGATTACGCCTCGTCCGTGCGCGG<br>TCGGGTGTCCATCAACGTGGACACCTCCAAGAA<br>CCAGTACTCCCTGCAACTGAACGCCGTGACCCCT<br>GAGGACACTGGGGTGTACTACTGTGCGAGAGTG<br>CGGCTGCAGGATGGGAACTCTTGGTCCGACGCCT<br>TCGATGTCTGGGGCCAGGGCACCATGGTCACTGT<br>GTCATCCGGCGGTGGTGGCAGCGGCGGAGGCGG<br>CAGCGGAGGCGGAGGAAGCCAGTCGGCACTGAC<br>CCAGCCTGCCTCAGCCTCCGGGAGCCCGGGACA<br>GTCCGTGACCATTTCCTGCACCGGGACCTCCTCC<br>GACGTGGGAGGCTACAACTACGTGTCATGGTAC<br>CAGCAGCACCCCGGAAAGGCACCGAAGCTGATG<br>ATCTACGACGTGTCCAACCGCCCGAGCGGGGTG<br>TCAAATCGCTTCTCGGGCTCGAAGTCGGGAAAC<br>ACAGCGAGCCTGACGATCTCGGGACTGCAAGCC<br>GAAGATGAGGCTGACTACTACTGCTCGTCCTACA<br>CTAGCTCCAGCACCCTCTACGTGTTCGGTACTGG<br>TACCCAGCTGACCGTCCTGACCACTACCCCAGCA<br>CCGAGGCCACCCACCCCGGCTCCTACCATCGCCT<br>CCCAGCCTCTGTCCCTGCGTCCGGAGGCATGTAG<br>ACCCGCAGCTGGTGGGGCCGTGCATACCCGGGG<br>TCTTGACTTCGCCTGCGATATCTACATTTGGGCC<br>CCTCTGGCTGGTACTTGCGGGGTCCTGCTGCTTT<br>CACTCGTGATCACTCTTTACTGTAAGCGCGGTCG<br>GAAGAAGCTGCTGTACATCTTTAAGCAACCCTTC<br>ATGAGGCCTGTGCAGACTACTCAAGAGGAGGAC<br>GGCTGTTCATGCCGGTTCCCAGAGGAGGAGGAA<br>GGCGGCTGCGAACTGCGCGTGAAATTCAGCCGC<br>AGCGCAGATGCTCCAGCCTACAAGCAGGGGCAG<br>AACCAGCTCTACAACGAACTCAATCTTGGTCGGA<br>GAGAGGAGTACGACGTGCTGGACAAGCGGAGAG<br>GACGGGACCCAGAAATGGGCGGGAAGCCGCGCA<br>GAAAGAATCCCCAAGAGGGGCCTGTACAACGAGC<br>TCCAAAAGGATAAGATGGCAGAAGCCTATAGCG |

TABLE 6-continued

CD22 CAR Constructs

| SEQ ID NUMBER | Ab region | Sequence |
|---|---|---|
| | | AGATTGGTATGAAAGGGGAACGCAGAAGAGGCA AAGGCCACGACGGACTGTACCAGGGACTCAGCA CCGCCACCAAGGACACCTATGACGCTCTTCACAT GCAGGCCCTGCCGCCTCGG |

CD22-53

| SEQ ID NO: 746 (Kabat) | HCDR1 | SNSAAWN |
| --- | --- | --- |
| SEQ ID NO: 747 (Kabat) | HCDR2 | RTYYRSKWYSDYAVSVKS |
| SEQ ID NO: 748 (Kabat) | HCDR3 | DPYDFWSGYPDAFDI |
| SEQ ID NO: 749 (Chothia) | HCDR1 | GDSVSSNSA |
| SEQ ID NO: 750 (Chothia) | HCDR2 | YYRSKWY |
| SEQ ID NO: 751 (Chothia) | HCDR3 | DPYDFWSGYPDAFDI |
| SEQ ID NO: 752 | VH | EVQLQQSGPGLVKPSQTLSLTCAISGDSVSSNSAA WNWIRQSPSRGLEWLGRTYYRSKWYSDYAVSVKS RITINPDTSKNQFSLQLNSVTPEDTAVYYCARDPYD FWSGYPDAFDIWGQGTMVTVSS |
| SEQ ID NO: 753 | DNA VH | GAGGTACAGCTGCAGCAGTCAGGTCCAGGACTG GTGAAGCCCTCGCAGACCCTCTCACTCACCTGTG CCATCTCCGGGGACAGTGTCTCTAGCAACAGTA TGCTTGGAACTGGATCAGGCAGTCCCCATCGAG AGGCCTTGAGTGGCTGGGAAGGACATACTACAG GTCCAAGTGGTATAGTGATTATGCAGTATCTGTG AAAAGTCGAATAACCATCAACCCAGACACATCC AAGAACCAGTTCTCCCTGCAGCTGAACTCTGTGA CTCCCGAGGACACGGCTGTGTATTACTGTGCAAG AGATCCTTACGATTTTTGGAGTGGTTATCCTGAT GCTTTTGATATCTGGGGCCAAGGGACAATGGTCA CCGTCTCTTCA |
| SEQ ID NO: 754 (Kabat) | LCDR1 | TGTSSDVGGYNYVS |
| SEQ ID NO: 755 (Kabat) | LCDR2 | EVNNRPS |
| SEQ ID NO: 756 (Kabat) | LCDR3 | SSYTSGRTLYV |
| SEQ ID NO: 757 (Chothia) | LCDR1 | TSSDVGGYNY |
| SEQ ID NO: 758 (Chothia) | LCDR2 | EVN |
| SEQ ID NO: 759 (Chothia) | LCDR3 | YTSGRTLY |
| SEQ ID NO: 760 | VL | QSALTQPASVSGSPGQSITISCTGTSSDVGGYNYVS WYQQHPGKAPKVIISEVNNRPSGVSHRFSGSKSGN TASLTISGLQAEDEADYFCSSYTSGRTLYVFGTGSK VTVLG |
| SEQ ID NO: 761 | DNA VL | CAGTCTGCCCTGACTCAGCCTGCCTCCGTGTCTG GGTCTCCTGGACAGTCGATCACCATCTCCTGCAC TGGAACCAGCAGTGACGTTGGTGGTTACAACTAT GTCTCCTGGTACCAACAGCACCCAGGCAAAGCC CCCAAGGTCATAATTTCTGAGGTCAATAATCGGC CCTCAGGGGTTTCTCATCGCTTCTCTGGGTCCAA GTCTGGCAACACGGCCTCCCTGACCATCTCTGGG CTCCAGGCTGAGGACGAGGCTGATTATTCTGCA GCTCATATACAAGTGGCAGGACTCTTTATGTCTT |

TABLE 6-continued

CD22 CAR Constructs

| SEQ ID NUMBER | Ab region | Sequence |
|---|---|---|
| | | CGGAACTGGGAGCAAGGTCACCGTCCTAGGT |
| SEQ ID NO: 762 | Linker | GGGGSGGGGSGGGGS |
| SEQ ID NO: 763 | scFv (VH-linker-VL) | EVQLQQSGPGLVKPSQTLSLTCAISGDSVSSNSAA WNWIRQSPSRGLEWLGRTYYRSKWYSDYAVSVKS RITINPDTSKNQFSLQLNSVTPEDTAVYYCARDPYD FWSGYPDAFDIWGQGTMVTVSSGGGGSGGGGSGG GGSQSALTQPASVSGSPGQSITISCTGTSSDVGGYN YVSWYQQHPGKAPKVIISEVNNRPSGVSHRFSGSK SGNTASLTISGLQAEDEADYFCSSYTSGRTLYVFGT GSKVTVLG |

An overview of the sequences identifications of CDR (Kabat) sequences of the CD22 scFv domains of Table 6 are shown in Table 7 for the heavy chain variable domains and in Table 8 for the light chain variable domains. The SEQ ID NO's refer to those found in Table 6.

TABLE 7

Heavy Chain Variable Domain CDR (Kabat) SEQ ID NO's of CD22 antibody molecules

| Candidate | HCDR1 | HCDR2 | HCDR3 |
|---|---|---|---|
| CD22-57 | 519 | 520 | 521 |
| CD22-58 | 544 | 545 | 546 |
| CD22-59 | 569 | 570 | 571 |
| CD22-60 | 594 | 595 | 596 |
| CD22-61 | 619 | 620 | 621 |
| CD22-62 | 644 | 645 | 646 |
| CD22-63 | 669 | 670 | 671 |
| CD22-64 | 694 | 695 | 696 |
| CD22-65 | 719 | 720 | 721 |

TABLE 8

Light Chain Variable Domain CDR (Kabat) of CD22 Antibody Molecules

| Candidate | LCDR1 | LCDR2 | LCDR3 |
|---|---|---|---|
| CD22-57 | 530 | 531 | 532 |
| CD22-58 | 555 | 556 | 557 |
| CD22-59 | 580 | 581 | 582 |
| CD22-60 | 605 | 606 | 607 |
| CD22-61 | 630 | 631 | 632 |
| CD22-62 | 655 | 656 | 657 |
| CD22-63 | 680 | 681 | 682 |
| CD22-64 | 705 | 706 | 707 |
| CD22-65 | 730 | 731 | 732 |

TABLE 9

Heavy Chain Variable Regions of CD22 antibody molecules

| Candidate | Heavy Chain Variable region |
|---|---|
| CD22-57 | 528 |
| CD22-58 | 553 |
| CD22-59 | 578 |
| CD22-60 | 603 |
| CD22-61 | 628 |
| CD22-62 | 653 |
| CD22-63 | 678 |

TABLE 9-continued

Heavy Chain Variable Regions of CD22 antibody molecules

| Candidate | Heavy Chain Variable region |
|---|---|
| CD22-64 | 703 |
| CD22-65 | 728 |

TABLE 10

Light Chain Variable Regions of CD22 antibody molecules

| Candidate | Light Chain Variable region |
|---|---|
| CD22-57 | 539 |
| CD22-58 | 564 |
| CD22-59 | 589 |
| CD22-60 | 614 |
| CD22-61 | 639 |
| CD22-62 | 664 |
| CD22-63 | 689 |
| CD22-64 | 714 |
| CD22-65 | 739 |

In some embodiments, the CD22 CAR comprises a short Gly-Ser linker (e.g., GGGGS linker (SEQ ID NO: 1083)) between the VH and VL sequences in the scFv as depicted in Construct CD22-65s, e.g., in Table 6.

In some embodiments, the CD22 CAR does not have a linker sequence between the VH and VL sequences in the scFv as depicted in Construct CD22-65ss, e.g., in Table 6.

In yet another embodiment, the CD22 CAR comprises one or more mutations relative to the amino acid sequence of CD22-65s, e.g., one or more mutations in the FR region of the VH and/or VL. In one embodiment, the CD22 CAR comprises a mutation at amino acid 41 of the VH region CD22-65s (e.g., a substitution of Q at position 41 of the VH of CD22-65s, e.g., for K); and/or a mutation of amino acid 40 of the VL of CD22-65s (e.g., a substitution of Q at position 40 of the VL of CD22-65s, e.g., for D). In one embodiment, the CD22CAR comprises the amino acid sequence of CD22-65sKD depicted below. An alignment of the CD22-65s and CD22-65sKD is depicted below (The alignment below discloses SEQ ID NOS 1101-1102, respectively, in order of appearance).

```
CD22-65sKD    1  EVQLQQSGPGLVKPSQTLSLTCAISGDSMLSNSDTWNWIRKSPSRGLEWL    50
                 |||||||||||||||||||||||||||||||||||||||||;||||||||
CD22-65s      1  EVQLQQSGPGLVKPSQTLSLTCAISGDSMLSNSDTWNWIRQSPSRGLEWL    50

CD22-65sKD   51  GRTYERSTWYDDYASSVRGRVSINVDTSKNQYSLQLNAVTPEDTGVYYCA   100
                 ||||||||||||||||||||||||||||||||||||||||||||||||||
CD22-65s     51  GRTYERSTWYDDYASSVRGRVSINVDTSKNQYSLQLNAVTPEDTGVYYCA   100

CD22-65sKD  101  RVRLQDGNSWSDAFDVWGQGTMVTVSSGGGGSQSALTQPASASGSPGQSV   150
                 ||||||||||||||||||||||||||||||||||||||||||||||||||
CD22-65s    101  RVRLQDGNSWSDAFDVWGQGTMVTVSSGGGGSQSALTQPASASGSPGQSV   150

CD22-65sKD  151  TISCTGTSSDVGGYNYVSWYQDHPGKAPKLMIYDVSNRPSGVSNRFSGSK   200
                 ||||||||||||||||||||||||.|||||||||||||||||||||||||
CD22-65s    151  TISCTGTSSDVGGYNYVSWYQQHPGKAPKLMIYDVSNRPSGVSNRFSGSK   200

CD22-65sKD  201  SGNTASLTISGLQAEDEADYYCSSYTSSSTLYVFGTGTQLTVL          243
                 ||||||||||||||||||||||||||||||||||||||||||
CD22-65s    201  SGNTASLTISGLQAEDEADYYCSSYTSSSTLYVFGTGTQLTVL          243
```

CD19 CAR Constructs

In one embodiment, an antigen binding domain against CD19 of the CAR construct is an antigen binding portion, e.g., CDRs of a CAR (e.g., CD19 CAR), antibody or antigen-binding fragment thereof described in, e.g., PCT publication WO2012/079000; PCT publication WO2014/153270; Kochenderfer, J. N. et al., J. Immunother. 32 (7), 689-702 (2009); Kochenderfer, J. N., et al., Blood, 116 (20), 4099-4102 (2010); PCT publication WO2014/031687; Bejcek, Cancer Research, 55, 2346-2351, 1995; or U.S. Pat. No. 7,446,190, each of which is hereby incorporated by reference in its entirety.

In one embodiment, the CD19 CAR comprises an amino acid sequence provided as SEQ ID NO: 12 in PCT publication WO2012/079000. In embodiment, the amino acid sequence is (SEQ ID NO: 1097)
(MALPVTALLLPLALLLHAARP)diqmtqttsslsaslgdrvtiscrasq diskylnwyqqkpdgtvklliyhtsrlhsgvpsrfsgsgsgtdysltisn leqediatyfcqqgntlpytfgggtkleitggggsggggsggggsevklq esgpglvapsqslsvtctvsgvslpdygvswirqpprkglewlgviwgse ttyynsalksrltiikdnsksqvflkmnslqtddtaiyycakhyyygsy amdywgqgtsvtvsstttpaprpptpaptiasqplslrpeacrpaaggav htrgldfacdiyiwaplagtcgvlllslvitlyckrgrkkllyifkqpfm rpvqttqeedgcscrfpeeeeggcelrvkfsrsadapaykqgqnqlynel nlgrreeydvldkrrgrdpemggkprrknpqeglynelqkdkmaeaysei gmkgerrrgkghdglyqglstatkdtydalhmqalppr, or a sequence substantially homologous thereto. The optional sequence of the signal peptide is shown in capital letters and parenthesis.

In one embodiment, the amino acid sequence is:

(SEQ ID NO: 1098)
diqmtqttsslsaslgdrvtiscrasqdiskylnwyqqkpdgtvklliyh tsrlhsgvpsrfsgsgsgtdysltisnleqediatyfcqqgntlpytfgg gtkleitggggsggggsggggsevklqesgpglvapsqslsvtctvsgvs lpdygvswirqpprkglewlgviwgsettyynsalksrltiikdnsksqv -continued flkmnslqtddtaiyycakhyyyggsyamdywgqgtsvtvsstttpaprp ptpaptiasqplslrpeacrpaaggavhtrgldfacdiyiwaplagtcgv lllslvitlyckrgrkkllyifkqpfmrpvqttqeedgcscrfpeeeegg celrvkfsrsadapaykqgqnqlynelnlgrreeydvldkrrgrdpemgg kprrknpqeglynelqkdkmaeayseigmkgerrrgkghdglyqglstat kdtydalhmqalppr, or a sequence substantially homologous thereto.

In one embodiment, the CD19 CAR has the USAN designation TISAGENLECLEUCEL-T. In embodiments, CTL019 is made by a gene modification of T cells is mediated by stable insertion via transduction with a self-inactivating, replication deficient Lentiviral (LV) vector containing the CTL019 transgene under the control of the EF-1 alpha promoter. CTL019 can be a mixture of transgene positive and negative T cells that are delivered to the subject on the basis of percent transgene positive T cells.

In some embodiments, the CD19 CAR comprises an antigen binding domain (e.g., a humanized antigen binding domain) according to Table 3 of WO2014/153270, incorporated herein by reference.

Humanization of murine CD19 antibody is desired for the clinical setting, where the mouse-specific residues may induce a human-anti-mouse antigen (HAMA) response in patients who receive CART19 treatment, i.e., treatment with T cells transduced with the CAR19 construct. The production, characterization, and efficacy of humanized CD19 CAR sequences is described in International Application WO2014/153270 which is herein incorporated by reference in its entirety, including Examples 1-5 (p. 115-159), for instance Tables 3, 4, and 5 (p. 125-147). In one embodiment, the CD19 CAR includes a CAR molecule, or an antigen binding domain (e.g., a humanized antigen binding domain) according to Table 3 of WO2014/153270, incorporated herein by reference. The amino acid and nucleotide sequences encoding the CD19 CAR molecules and antigen binding domains (e.g., including one, two, three VH CDRs; and one, two, three VL CDRs according to Kabat or Chothia), are specified in WO2014/153270. In embodiments, the CD19 CAR, or antigen binding domain, comprises an amino acid, or has a nucleotide sequence shown in WO2014/153270 incorporated herein by reference, or a sequence substantially identical to any of the aforesaid sequences (e.g., at least 85%, 90%, 95% or more identical to any of the aforesaid sequences).

In some embodiments, CD19 CAR constructs are described in PCT publication WO 2012/079000, incorporated herein by reference, and the amino acid sequence of the murine CD19 CAR and scFv constructs are shown in Table 11 below, or a sequence substantially identical to any of the aforesaid sequences (e.g., at least 85%, 90%, 95% or more identical to any of the sequences described herein).

TABLE 11

CD19 CAR Constructs

| SEQ ID NUMBER | Region | Sequence |
|---|---|---|
| CTL019 | | |
| SEQ ID NO: 764 | CTL019 Full amino acid sequence | MALPVTALLLPLALLLHAARPDIQMTQTTSSLSASLGD RVTISCRASQDISKYLNWYQQKPDGTVKLLIYHTSRLH SGVPSRFSGSGSGTDYSLTISNLEQEDIATYFCQQGNTL PYTFGGGTKLEITGGGGSGGGGSGGGGSEVKLQESGP GLVAPSQSLSVTCTVSGVSLPDYGVSWIRQPPRKGLE WLGVIWGSETTYYNSALKSRLTIIKDNSKSQVFLKMN SLQTDDTAIYYCAKHYYYGGSYAMDYWGQGTSVTVS STTTPAPRPPTPAPTIASQPLSLRPEACRPAAGGAVHTR GLDFACDIYIWAPLAGTCGVLLLSLVITLYCKRGRKKL LYIFKQPFMRPVQTTQEEDGCSCRFPEEEEGGCELRVK FSRSADAPAYKQGQNQLYNELNLGRREEYDVLDKRR GRDPEMGGKPRRKNPQEGLYNELQKDKMAEAYSEIG MKGERRRGKGHDGLYQGLSTATKDTYDALHMQALP PR |
| SEQ ID NO: 1042 | CTL019 Full nucleotide sequence | ATGGCCTTACCAGTGACCGCCTTGCTCCTGCCGCTG GCCTTGCTGCTCCACGCCGCCAGGCCGGACATCCAG ATGACACAGACTACATCCTCCCTGTCTGCCTCTCTG GGAGACAGAGTCACCATCAGTTGCAGGGCAAGTCA GGACATTAGTAAATATTTAAATTGGTATCAGCAGAA ACCAGATGGAACTGTTAAACTCCTGATCTACCATAC ATCAAGATTACACTCAGGAGTCCCATCAAGGTTCAG TGGCAGTGGGTCTGGAACAGATTATTCTCTCACCAT TAGCAACCTGGAGCAAGAAGATATTGCCACTTACTT TTGCCAACAGGGTAATACGCTTCCGTACACGTTCGG AGGGGGGACCAAGCTGGAGATCACAGGTGGCGGTG GCTCGGGCGGTGGTGGGTCGGGTGGCGGCGGATCT GAGGTGAAACTGCAGGAGTCAGGACCTGGCCTGGT GGCGCCCTCACAGAGCCTGTCCGTCACATGCACTGT CTCAGGGGTCTCATTACCCGACTATGGTGTAAGCTG GATTCGCCAGCCTCCACGAAAGGGTCTGGAGTGGCT GGGAGTAATATGGGGTAGTGAAACCACATACTATA ATTCAGCTCTCAAATCCAGACTGACCATCATCAAGG ACAACTCCAAGAGCCAAGTTTTCTTAAAAATGAACA GTCTGCAAACTGATGACACAGCCATTTACTACTGTG CCAAACATTATTACTACGGTGGTAGCTATGCTATGG ACTACTGGGGCCAAGGAACCTCAGTCACCGTCTCCT CAACCACGACGCCAGCGCCGCGACCACCAACACCG GCGCCCACCATCGCGTCGCAGCCCCTGTCCCTGCGC CCAGAGGCGTGCCGGCCAGCGGCGGGGGGCGCAGT GCACACGAGGGGGCTGGACTTCGCCTGTGATATCTA CATCTGGGCGCCCTTGGCCGGGACTTGTGGGGTCCT TCTCCTGTCACTGGTTATCACCCTTTACTGCAAACGG GGCAGAAAGAAACTCCTGTATATATTCAAACAACC ATTTATGAGACCAGTACAAACTACTCAAGAGGAAG ATGGCTGTAGCTGCCGATTTCCAGAAGAAGAAGAA GGAGGATGTGAACTGAGAGTGAAGTTCAGCAGGAG CGCAGACGCCCCCGCGTACAAGCAGGGCCAGAACC AGCTCTATAACGAGCTCAATCTAGGACGAAGAGAG GAGTACGATGTTTTGGACAAGAGACGTGGCCGGGA CCCTGAGATGGGGGGAAAGCCGAGAAGGAAGAACC CTCAGGAAGGCCTGTACAATGAACTGCAGAAAGAT AAGATGGCGGAGGCCTACAGTGAGATTGGGATGAA AGGCGAGCGCCGGAGGGGCAAGGGGCACGATGGCC TTTACCAGGGTCTCAGTACAGCCACCAAGGACACCT ACGACGCCCTTCACATGCAGGCCCTGCCCCCTCGC |
| SEQ ID NO: 765 | CTL019 scFv domain | DIQMTQTTSSLSASLGDRVTISCRASQDISKYLNWYQQ KPDGTVKLLIYHTSRLHSGVPSRFSGSGSGTDYSLTISN LEQEDIATYFCQQGNTLPYTFGGGTKLEITGGGGSGGG GSGGGGSEVKLQESGPGLVAPSQSLSVTCTVSGVSLPD YGVSWIRQPPRKGLEWLGVIWGSETTYYNSALKSRLT IIKDNSKSQVFLKMNSLQDDTAIYYCAKHYYYGGSY AMDYWGQGTSVTVSS |

TABLE 11-continued

| CD19 CAR Constructs | | |
|---|---|---|
| SEQ ID NUMBER | Region | Sequence | mCAR1

| SEQ ID NO: 766 | mCAR1 scFv | QVQLLESGAELVRPGSSVKISCKASGYAFSSYWMNW VKQRPGQGLEWIGQIYPGDGDTNYNGKFKGQATLTA DKSSSTAYMQLSGLTSEDSAVYSCARKTISSVVDFYFD YWGQGTTVTGGGSGGGSGGGSGGGSELVLTQSPKFM STSVGDRVSVTCKASQNVGTNVAWYQQKPGQSPKPLI YSATYRNSGVPDRFTGSGSGTDFTLTITNVQSKDLADY FCQYNRYPYTSFFFTKLEIKRRS |
|---|---|---|
| SEQ ID NO: 767 | mCAR1 Full amino acid sequence | QVQLLESGAELVRPGSSVKISCKASGYAFSSYWMNW VKQRPGQGLEWIGQIYPGDGDTNYNGKFKGQATLTA DKSSSTAYMQLSGLTSEDSAVYSCARKTISSVVDFYFD YWGQGTTVTGGGSGGGSGGGSGGGSELVLTQSPKFM STSVGDRVSVTCKASQNVGTNVAWYQQKPGQSPKPLI YSATYRNSGVPDRFTGSGSGTDFTLTITNVQSKDLADY FCQYNRYPYTSFFFTKLEIKRRSKIEVMYPPPYLDNEKS NGTIIHVKGKHLCPSPLFPGPSKPFWVLVVVGGVLACY SLLVTVAFIIFWVRSKRSRLLHSDYMNMTPRRPGPTRK HYQPYAPPRDFAAYRSRVKFSRSADAPAYQQGQNQL YNELNLGRREEYDVLDKRRGRDPEMGGKPRRKNPQE GLYNELQKDKMAEAYSEIGMKGERRRGKGHDGLYQ GLSTATKDTYDALHMQALPPR | mCAR2

| SEQ ID NO: 768 | mCAR2 scFv | DIQMTQTTSSLSASLGDRVTISCRASQDISKYLNWYQQ KPDGTVKLLIYHTSRLHSGVPSRFSGSGSGTDYSLTISN LEQEDIATYFCQQGNTLPYTFGGGTKLEITGSTSGSGK PGSGEGSTKGEVKLQESGPGLVAPSQSLSVTCTVSGVS LPDYGVSWIRQPPRKGLEWLGVIWGSETTYYNSALKS RLTIIKDNSKSQVFLKMNSLQTDDTAIYYCAKHYYYG GSYAMDYWGQGTSVTVSSE |
|---|---|---|
| SEQ ID NO: 769 | mCAR2 amino acid sequence | DIQMTQTTSSLSASLGDRVTISCRASQDISKYLNWYQQ KPDGTVKLLIYHTSRLHSGVPSRFSGSGSGTDYSLTISN LEQEDIATYFCQQGNTLPYTFGGGTKLEITGSTSGSGK PGSGEGSTKGEVKLQESGPGLVAPSQSLSVTCTVSGVS LPDYGVSWIRQPPRKGLEWLGVIWGSETTYYNSALKS RLTIIKDNSKSQVFLKMNSLQTDDTAIYYCAKHYYYG GSYAMDYWGQGTSVTVSSESKYGPPCPPCPMFWVLV VVGGVLACYSLLVTVAFIIFWVKRGRKKLLYIFKQPF MRPVQTTQEEDGCSCRFEEEEGGCELRVKFSRSADAP AYQQGQNQLYNELNLGRREEYDVLDKRRGRDPEMG GKPRRKNPQEGLYNELQKDKMAEAYSEIGMKGERRR GKGHDGLYQGLSTATKDTYDALHMQALPPRL |
| SEQ ID NO: 770 | mCAR2 full amino acid sequence | DIQMTQTTSSLSASLGDRVTISCRASQDISKYLNWYQQ KPDGTVKLLIYHTSRLHSGVPSRFSGSGSGTDYSLTISN LEQEDIATYFCQQGNTLPYTFGGGTKLEITGSTSGSGK PGSGEGSTKGEVKLQESGPGLVAPSQSLSVTCTVSGVS LPDYGVSWIRQPPRKGLEWLGVIWGSETTYYNSALKS RLTIIKDNSKSQVFLKMNSLQTDDTAIYYCAKHYYYG GSYAMDYWGQGTSVTVSSESKYGPPCPPCPMFWVLV VVGGVLACYSLLVTVAFIIFWVKRGRKKLLYIFKQPF MRPVQTTQEEDGCSCRFEEEEGGCELRVKFSRSADAP AYQQGQNQLYNELNLGRREEYDVLDKRRGRDPEMG GKPRRKNPQEGLYNELQKDKMAEAYSEIGMKGERRR GKGHDGLYQGLSTATKDTYDALHMQALPPRLEGGGE GRGSLLTCGDVEENPGPRMLLLVTSLLLCELPHPAFLL IPRKVCNGIGIGEFKDSLSINATNIKHFKNCTSISGDLHI LPVAFRGDSFTHTPPLDPQELDILKTVKEITGFLLIQAW PENRTDLHAFENLEIIRGRTKQHGQFSLAVVSLNITSLG LRSLKEISDGDVIISGNKNLCYANTINWKKLFGTSGQK TKIISNRGENSCKATGQVCHALCSPEGCWGPEPRDCVS CRNVSRGRECVDKCNLLEGEPREFVENSECIQCHPECL PQAMNITCTGRGPDNCIQCAHYIDGPHCVKTCPAGVM GENNTLVWKYADAGHVCHLCHPNCTYGCTGPGLEGC PTNGPKIPSIATGMVGALLLLLVVALGIGLFM | mCAR3

| SEQ ID NO: 771 | mCAR3 scFv | DIQMTQTTSSLSASLGDRVTISCRASQDISKYLNWYQQ KPDGTVKLLIYHTSRLHSGVPSRFSGSGSGTDYSLTISN |
|---|---|---|

TABLE 11-continued

CD19 CAR Constructs

| SEQ ID NUMBER | Region | Sequence |
|---|---|---|
| | | LEQEDIATYFCQQGNTLPYTFGGGTKLEITGSTSGSGK PGSGEGSTKGEVKLQESGPGLVAPSQSLSVTCTVSGVS LPDYGVSWIRQPPRKGLEWLGVIWGSETTYYNSALKS RLTIIKDNSKSQVFLKMNSLQTDDTAIYYCAKHYYYG GSYAMDYWGQGTSVTVSS |
| SEQ ID NO: 772 | mCAR3 full amino acid sequence | DIQMTQTTSSLSASLGDRVTISCRASQDISKYLNWYQQ KPDGTVKLLIYHTSRLHSGVPSRFSGSGSGTDYSLTISN LEQEDIATYFCQQGNTLPYTFGGGTKLEITGSTSGSGK PGSGEGSTKGEVKLQESGPGLVAPSQSLSVTCTVSGVS LPDYGVSWIRQPPRKGLEWLGVIWGSETTYYNSALKS RLTIIKDNSKSQVFLKMNSLQTDDTAIYYCAKHYYYG GSYAMDYWGQGTSVTVSSAAAIEVMYPPPYLDNEKS NGTIIHVKGKHLCPSPLFPGPSKPFWVLVVVGGVLACY SLLVTVAFIIFWVRSKRSRLLHSDYMNMTPRRPGPTRK HYQPYAPPRDFAAYRSRVKFSRSADAPAYQQGQNQL YNELNLGRREEYDVLDKRRGRDPEMGGKPRRKNPQE GLYNELQKDKMAEAYSEIGMKGERRRGKGHDGLYQ GLSTATKDTYDALHMQALPPR |

SSJ25-C1

| SEQ ID NO: 1043 | SSJ25-C1 VH sequence | QVQLLESGAELVRPGSSVKISCKASGYAFSSYWMNW VKQRPGQGLEWIGQIYPGDGDTNYNGKFKGQATLTA DKSSSTAYMQLSGLTSEDSAVYSCARKTISSVVDFYFD YWGQGTTVT |
| SEQ ID NO: 1044 | SSJ25-C1 VL | ELVLTQSPKFMSTSVGDRVSVTCKASQNVGTNVAWY QQKPGQSPKPLIYSATYRNSGVPDRFTGSGSGTDFTLTI TNVQSKDLADYFYFCQYNRYPYTSGGGTKLEIKRRS |

Humanized CAR1

| SEQ ID NO: 1045 | CAR1 scFv domain | EIVMTQSPATLSLSPGERATLSCRASQDISKYLNWYQQ KPGQAPRLLIYHTSRLHSGIPARFSGSGSGTDYTLTISSL QPEDFAVYFCQQGNTLPYTFGQGTKLEIKGGGGSGGG GSGGGGSQVQLQESGPGLVKPSETLSLTCTVSGVSLPD YGVSWIRQPPGKGLEWIGVIWGSETTYYSSSLKSRVTI SKDNSKNQVSLKLSSVTAADTAVYYCAKHYYYGGSY AMDYWGQGTLVTVSS |
| SEQ ID NO: 1046 | CAR 1-Full-aa | MALPVTALLLPLALLLHAARPEIVMTQSPATLSLSPGE RATLSCRASQDISKYLNWYQQKPGQAPRLLIYHTSRL HSGIPARFSGSGSGTDYTLTISSLQPEDFAVYFCQQGNT LPYTFGQGTKLEIKGGGGSGGGGSGGGGSQVQLQESG PGLVKPSETLSLTCTVSGVSLPDYGVSWIRQPPGKGLE WIGVIWGSETTYYSSSLKSRVTISKDNSKNQVSLKLSS VTAADTAVYYCAKHYYYGGSYAMDYWGQGTLVTVSS STTTPAPRPPTPAPTIASQPLSLRPEACRPAAGGAVHTR GLDFACDIYIWAPLAGTCGVLLLSLVITLYCKRGRKKL LYIFKQPFMRPVQTTQEEDGCSCRFPEEEEGGCELRVK FSRSADAPAYKQGQNQLYNELNLGRREEYDVLDKRR GRDPEMGGKPRRKNPQEGLYNELQKDKMAEAYSEIG MKGERRRGKGHDGLYQGLSTATKDTYDALHMQALP PR |

Humanized CAR2

| SEQ ID NO: 1047 | CAR2 scFv domain-aa (Linker is underlined) | EIVMTQSPATLSLSPGERATLSCRASQDISKYLNWYQQ KPGQAPRLLIYHTSRLHSGIPARFSGSGSGTDYTLTISSL QPEDFAVYFCQQGNTLPYTFGQGTKLEIK<u>GGGGSGGG GSGGGGS</u>QVQLQESGPGLVKPSETLSLTCTVSGVSLPD YGVSWIRQPPGKGLEWIGVIWGSETTYYQSSLKSRVTI SKDNSKNQVSLKLSSVTAADTAVYYCAKHYYYGGSY AMDYWGQGTLVTVSS |
| SEQ ID NO: 1048 | CAR2 scFv domain-nt | atggccctccctgtcaccgccctgctgcttccgctggctcttctgctccacgccgctcg gcccgaaattgtgatgacccagtcacccgccactcttagcctttcaccggtgagcgc gcaaccctgtcttgcagagcatctcaaagacatctcaaaataccttaattggtatcaaca gaagcccggacaggctcctcgccttctgatctaccacaccagccggtccattctgga atccctgccaggttcagcggtagcggatctgggaccgactacaccctcactatcagct cactgcagccagaggacttcgctgtctatttctgtcagcaagggaacaccctgcccta cacctttggacagggcaccaagctcgagattaaaggtggaggtggcagcggagga |

TABLE 11-continued

CD19 CAR Constructs

| SEQ ID NUMBER | Region | Sequence |
|---|---|---|
| | | ggtgggtccggcggtggaggaagccaggtccaactccaagaaagcggaccgggtc<br>ttgtgaagccatcagaaactctttcactgacttgtactgtgagcggagtgtctctccccg<br>attacggggtgtcttggatcagacagccaccggggaagggtctggaatggattggag<br>tgatttggggctctgagactacttactaccaatcatccctcaagtcacgcgtcaccatct<br>caaaggacaactctaagaatcaggtgtcactgaaactgtcatctgtgaccgcagccga<br>caccgccgtgtactattgcgctaagcattactattatggcgggagctacgcaatggatt<br>actggggacagggtactctggtcaccgtgtccagccaccaccatcatcaccatcacc<br>at |
| SEQ ID NO: 1049 | CAR 2-Full-aa | MALPVTALLLPLALLLHAARPEIVMTQSPATLSLSPGE<br>RATLSCRASQDISKYLNWYQQKPGQAPRLLIYHTSRL<br>HSGIPARFSGSGSGTDYTLTISSLQPEDFAVYFCQQGNT<br>LPYTFGQGTKLEIKGGGGSGGGGSGGGGSQVQLQESG<br>PGLVKPSETLSLTCTVSGVSLPDYGVSWIRQPPGKGLE<br>WIGVIWGSETTYYQSSLKSRVTISKDNSKNQVSLKLSS<br>VTAADTAVYYCAKHYYYGGSYAMDYWGQGTLVTVS<br>STTTPAPRPPTPAPTIASQPLSLRPEACRPAAGGAVHTR<br>GLDFACDIYIWAPLAGTCGVLLLSLVITLYCKRGRKKL<br>LYIFKQPFMRPVQTTQEEDGCSCRFPEEEEGGCELRVK<br>FSRSADAPAYKQGQNQLYNELNLGRREEYDVLDKRR<br>GRDPEMGGKPRRKNPQEGLYNELQKDKMAEAYSEIG<br>MKGERRRGKGHDGLYQGLSTATKDTYDALHMQALP<br>PR |
| SEQ ID NO: 1050 | CAR 2-Full-nt | atggccctcccgtcaccgccctgctgcttccgctggctcttctgctccacgccgctcg<br>gcccgaaattgtgatgacccagtcacccgccactcttagcctttcacccggtgagcgc<br>gcaaccctgtcttgcagagcctcccaagacatctcaaataccttaattggtatcaaca<br>gaagcccggacaggctcctcgccttctgatctaccacaccagccggctccattctgga<br>atccctgccaggttcagcggtagcggatctgggaccgactacaccctcactatcagct<br>cactgcagccagaggacttcgctgtctatttctgtcagcaagggaacaccctgcccta<br>cacctttggacagggcaccaagctcgagattaaaggtggaggtggcagcggagga<br>ggtgggtccggcggtggaggaagccaggtccaactccaagaaagcggaccgggtc<br>ttgtgaagccatcagaaactctttcactgacttgtactgtgagcggagtgtctctccccg<br>attacggggtgtcttggatcagacagccaccggggaagggtctggaatggattggag<br>tgatttggggctctgagactacttactaccaatcatccctcaagtcacgcgtcaccatct<br>caaaggacaactctaagaatcaggtgtcactgaaactgtcatctgtgaccgcagccga<br>caccgccgtgtactattgcgctaagcattactattatggcgggagctacgcaatggatt<br>actggggacagggtactctggtcaccgtgtccagcaccactaccccagcaccgagg<br>ccacccaccccggctcctaccatcgcctcccagcctctgtccctgcgtccggaggcat<br>gtagacccgcagctggtgggcgtgcataccgggtcttgacttcgcctgcgatat<br>ctacatttgggcccctctggctggtacttgcggggtcctgctgctttcactcgtgatcact<br>ctttactgtaagcgcggtcggaagaagctgctgtacatcttttaagcaacccttcatgag<br>gcctgtgcagactactcaagaggaggacggctgttcatgccggttcccagaggagg<br>aggaaggcggctgcgaactgcgcgtgaaattcagccgcagccagatgctccagc<br>ctacaagcaggggcagaaccagctctacaacgaactcaatcttggtcggagagagg<br>agtacgacgtgctggacaagcggagaggacgggacccagaaatgggcgggaagc<br>cgcgcagaaagaatccccaagagggcctgtacaacgagctccaaaaggataagatg<br>gcagaagcctatagcgagattggtatgaaaggggaacgcagaagaggcaaaggcc<br>acgacggactgtaccagggactcagcaccgccaccaaggacacctatgacgctcttc<br>acatgcaggccctgccgcctcgg |
| SEQ ID NO: 1051 | CAR2-Soluble scFv-aa | MALPVTALLLPLALLLHAARPeivmtqspatlslspgeratlscrasqd<br>iskylnwyqqkpgqaprlliyhtsrlhsgiparfsgsgsgtdytltiss<br>lqpedfavyfcqqgntlpytfgqgtkleikggggsggggsggggsqvql<br>qesgpglvkpsetlsltctvsgvslpdygvswirqppgkglewigviwg<br>settyyqsslksrvtiskdnsknqvslklssvtaadtavyycakhyyyg<br>gsyamdywgqgtlvtvsshhhhhhhh |

Humanized CAR3

| SEQ ID NO: 1052 | CAR3 scFv domain | QVQLQESGPGLVKPSETLSLTCTVSGVSLPDYGVSWIR<br>QPPGKGLEWIGVIWGSETTYYSSSLKSRVTISKDNSKN<br>QVSLKLSSVTAADTAVYYCAKHYYYGGSYAMDYWG<br>QGTLVTVSSGGGGSGGGGSGGGGSEIVMTQSPATLSL<br>SPGERATLSCRASQDISKYLNWYQQKPGQAPRLLIYHT<br>SRLHSGIPARFSGSGSGTDYTLTISSLQPEDFAVYFCQQ<br>GNTLPYTFGQGTKLEIK |
| SEQ ID NO: 1053 | CAR 3-Full-aa | MALPVTALLLPLALLLHAARPQVQLQESGPGLVKPSE<br>TLSLTCTVSGVSLPDYGVSWIRQPPGKGLEWIGVIWGS<br>ETTYYSSSLKSRVTISKDNSKNQVSLKLSSVTAADTAV<br>YYCAKHYYYGGSYAMDYWGQGTLVTVSSGGGGSGG<br>GGSGGGGSEIVMTQSPATLSLSPGERATLSCRASQDIS<br>KYLNWYQQKPGQAPRLLIYHTSRLHSGIPARFSGSGSG |

TABLE 11-continued

CD19 CAR Constructs

| SEQ ID NUMBER | Region | Sequence |
|---|---|---|
| | | TDYTLTISSLQPEDFAVYFCQQGNTLPYTFGQGTKLEI<br>KTTTPAPRPPTPAPTIASQPLSLRPEACRPAAGGAVHTR<br>GLDFACDIYIWAPLAGTCGVLLLSLVITLYCKRGRKKL<br>LYIFKQPFMRPVQTTQEEDGCSCRFPEEEEGGCELRVK<br>FSRSADAPAYKQGQNQLYNELNLGRREEYDVLDKRR<br>GRDPEMGGKPRRKNPQEGLYNELQKDKMAEAYSEIG<br>MKGERRRGKGHDGLYQGLSTATKDTYDALHMQALP<br>PR |

Humanized CAR4

| SEQ ID NO: 1054 | CAR4 scFv domain | QVQLQESGPGLVKPSETLSLTCTVSGVSLPDYGVSWIR<br>QPPGKGLEWIGVIWGSETTYYQSSLKSRVTISKDNSKN<br>QVSLKLSSVTAADTAVYYCAKHYYYGGSYAMDYWG<br>QGTLVTVSSGGGGSGGGGSGGGGSEIVMTQSPATLSL<br>SPGERATLSCRASQDISKYLNWYQQKPGQAPRLLIYHT<br>SRLHSGIPARFSGSGSGTDYTLTISSLQPEDFAVYFCQQ<br>GNTLPYTFGQGTKLEIK |
| SEQ ID NO: 1055 | CAR 4-Full-aa | MALPVTALLLPLALLLHAARPQVQLQESGPGLVKPSE<br>TLSLTCTVSGVSLPDYGVSWIRQPPGKGLEWIGVIWGS<br>ETTYYQSSLKSRVTISKDNSKNQVSLKLSSVTAADTAV<br>YYCAKHYYYGGSYAMDYWGQGTLVTVSSGGGGSGG<br>GGSGGGGSEIVMTQSPATLSLSPGERATLSCRASQDIS<br>KYLNWYQQKPGQAPRLLIYHTSRLHSGIPARFSGSGSG<br>TDYTLTISSLQPEDFAVYFCQQGNTLPYTFGQGTKLEI<br>KTTTPAPRPPTPAPTIASQPLSLRPEACRPAAGGAVHTR<br>GLDFACDIYIWAPLAGTCGVLLLSLVITLYCKRGRKKL<br>LYIFKQPFMRPVQTTQEEDGCSCRFPEEEEGGCELRVK<br>FSRSADAPAYKQGQNQLYNELNLGRREEYDVLDKRR<br>GRDPEMGGKPRRKNPQEGLYNELQKDKMAEAYSEIG<br>MKGERRRGKGHDGLYQGLSTATKDTYDALHMQALP<br>PR |

Humanized CAR5

| SEQ ID NO: 1056 | CAR5 scFv domain | EIVMTQSPATLSLSPGERATLSCRASQDISKYLNWYQQ<br>KPGQAPRLLIYHTSRLHSGIPARFSGSGSGTDYTLTISSL<br>QPEDFAVYFCQQGNTLPYTFGQGTKLEIKGGGGSGGG<br>GSGGGGSGGGGSQVQLQESGPGLVKPSETLSLTCTVS<br>GVSLPDYGVSWIRQPPGKGLEWIGVIWGSETTYYSSSL<br>KSRVTISKDNSKNQVSLKLSSVTAADTAVYYCAKHYY<br>YGGSYAMDYWGQGTLVTVSS |
| SEQ ID NO: 1057 | CAR 5-Full-aa | MALPVTALLLPLALLLHAARPEIVMTQSPATLSLSPGE<br>RATLSCRASQDISKYLNWYQQKPGQAPRLLIYHTSRL<br>HSGIPARFSGSGSGTDYTLTISSLQPEDFAVYFCQQGNT<br>LPYTFGQGTKLEIKGGGGSGGGGSGGGGSGGGGSQV<br>QLQESGPGLVKPSETLSLTCTVSGVSLPDYGVSWIRQP<br>PGKGLEWIGVIWGSETTYYSSSLKSRVTISKDNSKNQV<br>SLKLSSVTAADTAVYYCAKHYYYGGSYAMDYWGQG<br>TLVTVSSTTTPAPRPPTPAPTIASQPLSLRPEACRPAAG<br>GAVHTRGLDFACDIYIWAPLAGTCGVLLLSLVITLYCK<br>RGRKKLLYIFKQPFMRPVQTTQEEDGCSCRFPEEEEGG<br>CELRVKFSRSADAPAYKQGQNQLYNELNLGRREEYD<br>VLDKRRGRDPEMGGKPRRKNPQEGLYNELQKDKMA<br>EAYSEIGMKGERRRGKGHDGLYQGLSTATKDTYDAL<br>HMQALPPR |

Humanized CAR6

| SEQ ID NO: 1058 | CAR6 scFv domain | EIVMTQSPATLSLSPGERATLSCRASQDISKYLNWYQQ<br>KPGQAPRLLIYHTSRLHSGIPARFSGSGSGTDYTLTISSL<br>QPEDFAVYFCQQGNTLPYTFGQGTKLEIKGGGGSGGG<br>GSGGGGSGGGGSQVQLQESGPGLVKPSETLSLTCTVS<br>GVSLPDYGVSWIRQPPGKGLEWIGVIWGSETTYYQSS<br>LKSRVTISKDNSKNQVSLKLSSVTAADTAVYYCAKHY<br>YYGGSYAMDYWGQGTLVTVSS |
| SEQ ID NO: 1059 | CAR6-Full-aa | MALPVTALLLPLALLLHAARPEIVMTQSPATLSLSPGE<br>RATLSCRASQDISKYLNWYQQKPGQAPRLLIYHTSRL<br>HSGIPARFSGSGSGTDYTLTISSLQPEDFAVYFCQQGNT |

TABLE 11-continued

CD19 CAR Constructs

| SEQ ID NUMBER | Region | Sequence |
|---|---|---|
| | | LPYTFGQGTKLEIKGGGGSGGGGSGGGGSGGGGSQV QLQESGPGLVKPSETLSLTCTVSGVSLPDYGVSWIRQP PGKGLEWIGVIWGSETTYYQSSLKSRVTISKDNSKNQV SLKLSSVTAADTAVYYCAKHYYYGGSYAMDYWGQG TLVTVSSTTTPAPRPPTPAPTIASQPLSLRPEACRPAAG GAVHTRGLDFACDIYIWAPLAGTCGVLLLSLVITLYCK RGRKKLLYIFKQPFMRPVQTTQEEDGCSCRFPEEEEGG CELRVKFSRSADAPAYKQGQNQLYNELNLGRREEYD VLDKRRGRDPEMGGKPRRKNPQEGLYNELQKDKMA EAYSEIGMKGERRRGKGHDGLYQGLSTATKDTYDAL HMQALPPR |

Humanized CAR7

| SEQ ID NO: 1060 | CAR7 scFv domain | QVQLQESGPGLVKPSETLSLTCTVSGVSLPDYGVSWIR QPPGKGLEWIGVIWGSETTYYSSSLKSRVTISKDNSKN QVSLKLSSVTAADTAVYYCAKHYYYGGSYAMDYWG QGTLVTVSSGGGGSGGGGSGGGGSGGGGSEIVMTQSP ATLSLSPGERATLSCRASQDISKYLNWYQQKPGQAPR LLIYHTSRLHSGIPARFSGSGSGTDYTLTISSLQPEDFAV YFCQQGNTLPYTFGQGTKLEIK |
| SEQ ID NO: 1061 | CAR 7 Full-aa | MALPVTALLLPLALLLHAARPQVQLQESGPGLVKPSE TLSLTCTVSGVSLPDYGVSWIRQPPGKGLEWIGVIWGS ETTYYSSSLKSRVTISKDNSKNQVSLKLSSVTAADTAV YYCAKHYYYGGSYAMDYWGQGTLVTVSSGGGGSGG GGSGGGGSGGGGSEIVMTQSPATLSLSPGERATLSCRA SQDISKYLNWYQQKPGQAPRLLIYHTSRLHSGIPARFS GSGSGTDYTLTISSLQPEDFAVYFCQQGNTLPYTFGQG TKLEIKTTTPAPRPPTPAPTIASQPLSLRPEACRPAAGG AVHTRGLDFACDIYIWAPLAGTCGVLLLSLVITLYCKR GRKKLLYIFKQPFMRPVQTTQEEDGCSCRFPEEEEGGC ELRVKFSRSADAPAYKQGQNQLYNELNLGRREEYDV LDKRRGRDPEMGGKPRRKNPQEGLYNELQKDKMAE AYSEIGMKGERRRGKGHDGLYQGLSTATKDTYDALH MQALPPR |

Humanized CAR8

| SEQ ID NO: 1062 | CAR8 scFv domain | QVQLQESGPGLVKPSETLSLTCTVSGVSLPDYGVSWIR QPPGKGLEWIGVIWGSETTYYQSSLKSRVTISKDNSKN QVSLKLSSVTAADTAVYYCAKHYYYGGSYAMDYWG QGTLVTVSSGGGGSGGGGSGGGGSGGGGSEIVMTQSP ATLSLSPGERATLSCRASQDISKYLNWYQQKPGQAPR LLIYHTSRLHSGIPARFSGSGSGTDYTLTISSLQPEDFAV YFCQQGNTLPYTFGQGTKLEIK |
| SEQ ID NO: 1063 | CAR 8-Full-aa | MALPVTALLLPLALLLHAARPQVQLQESGPGLVKPSE TLSLTCTVSGVSLPDYGVSWIRQPPGKGLEWIGVIWGS ETTYYQSSLKSRVTISKDNSKNQVSLKLSSVTAADTAV YYCAKHYYYGGSYAMDYWGQGTLVTVSSGGGGSGG GGSGGGGSGGGGSEIVMTQSPATLSLSPGERATLSCRA SQDISKYLNWYQQKPGQAPRLLIYHTSRLHSGIPARFS GSGSGTDYTLTISSLQPEDFAVYFCQQGNTLPYTFGQG TKLEIKTTTPAPRPPTPAPTIASQPLSLRPEACRPAAGG AVHTRGLDFACDIYIWAPLAGTCGVLLLSLVITLYCKR GRKKLLYIFKQPFMRPVQTTQEEDGCSCRFPEEEEGGC ELRVKFSRSADAPAYKQGQNQLYNELNLGRREEYDV LDKRRGRDPEMGGKPRRKNPQEGLYNELQKDKMAE AYSEIGMKGERRRGKGHDGLYQGLSTATKDTYDALH MQALPPR |

Humanized CAR9

| SEQ ID NO: 1064 | CAR9 scFv domain | EIVMTQSPATLSLSPGERATLSCRASQDISKYLNWYQQ KPGQAPRLLIYHTSRLHSGIPARFSGSGSGTDYTLTISSL QPEDFAVYFCQQGNTLPYTFGQGTKLEIKGGGGSGGG GSGGGGSGGGGSQVQLQESGPGLVKPSETLSLTCTVS GVSLPDYGVSWIRQPPGKGLEWIGVIWGSETTYYNSS LKSRVTISKDNSKNQVSLKLSSVTAADTAVYYCAKHY YYGGSYAMDYWGQGTLVTVSS |

TABLE 11-continued

CD19 CAR Constructs

| SEQ ID NUMBER | Region | Sequence |
|---|---|---|
| SEQ ID NO: 1065 | CAR 9-Full-aa | MALPVTALLLPLALLLHAARPEIVMTQSPATLSLSPGE RATLSCRASQDISKYLNWYQQKPGQAPRLLIYHTSRL HSGIPARFSGSGSGTDYTLTISSLQPEDFAVYFCQQGNT LPYTFGQGTKLEIKGGGGSGGGGSGGGGSGGGGSQV QLQESGPGLVKPSETLSLTCTVSGVSLPDYGVSWIRQP PGKGLEWIGVIWGSETTYYNSSLKSRVTISKDNSKNQV SLKLSSVTAADTAVYYCAKHYYYGGSYAMDYWGQG TLVTVSSTTTPAPRPPTPAPTIASQPLSLRPEACRPAAG GAVHTRGLDFACDIYIWAPLAGTCGVLLLSLVITLYCK RGRKKLLYIFKQPFMRPVQTTQEEDGCSCRFPEEEEGG CELRVKFSRSADAPAYKQGQNQLYNELNLGRREEYD VLDKRRGRDPEMGGKPRRKNPQEGLYNELQKDKMA EAYSEIGMKGERRRGKGHDGLYQGLSTATKDTYDAL HMQALPPR |

Humanized CAR10

| SEQ ID NO: 1066 | CAR10 scFv domain | QVQLQESGPGLVKPSETLSLTCTVSGVSLPDYGVSWIR QPPGKGLEWIGVIWGSETTYYNSSLKSRVTISKDNSKN QVSLKLSSVTAADTAVYYCAKHYYYGGSYAMDYWG QGTLVTVSSGGGGSGGGGSGGGGSGGGGSEIVMTQSP ATLSLSPGERATLSCRASQDISKYLNWYQQKPGQAPR LLIYHTSRLHSGIPARFSGSGSGTDYTLTISSLQPEDFAV YFCQQGNTLPYTFGQGTKLEIK |

| SEQ ID NO: 1067 | CAR 10 Full-aa | MALPVTALLLPLALLLHAARPEIVMTQSPATLSLSPGE RATLSCRASQDISKYLNWYQQKPGQAPRLLIYHTSRL HSGIPARFSGSGSGTDYTLTISSLQPEDFAVYFCQQGNT LPYTFGQGTKLEIKGGGGSGGGGSGGGGSGGGGSQV QLQESGPGLVKPSETLSLTCTVSGVSLPDYGVSWIRQP PGKGLEWIGVIWGSETTYYNSSLKSRVTISKDNSKNQV SLKLSSVTAADTAVYYCAKHYYYGGSYAMDYWGQG TLVTVSSTTTPAPRPPTPAPTIASQPLSLRPEACRPAAG GAVHTRGLDFACDIYIWAPLAGTCGVLLLSLVITLYCK RGRKKLLYIFKQPFMRPVQTTQEEDGCSCRFPEEEEGG CELRVKFSRSADAPAYKQGQNQLYNELNLGRREEYD VLDKRRGRDPEMGGKPRRKNPQEGLYNELQKDKMA EAYSEIGMKGERRRGKGHDGLYQGLSTATKDTYDAL HMQALPPR |

Humanized CAR11

| SEQ ID NO: 1068 | CAR11 scFv domain | EIVMTQSPATLSLSPGERATLSCRASQDISKYLNWYQQ KPGQAPRLLIYHTSRLHSGIPARFSGSGSGTDYTLTISSL QPEDFAVYFCQQGNTLPYTFGQGTKLEIKGGGGSGGG GSGGGGSQVQLQESGPGLVKPSETLSLTCTVSGVSLPD YGVSWIRQPPGKGLEWIGVIWGSETTYYNSSLKSRVTI SKDNSKNQVSLKLSSVTAADTAVYYCAKHYYYGGSY AMDYWGQGTLVTVSS |

| SEQ ID NO: 1069 | CAR 11 Full-aa | MALPVTALLLPLALLLHAARPQVQLQESGPGLVKPSE TLSLTCTVSGVSLPDYGVSWIRQPPGKGLEWIGVIWGS ETTYYNSSLKSRVTISKDNSKNQVSLKLSSVTAADTAV YYCAKHYYYGGSYAMDYWGQGTLVTVSSGGGGSGG GGSGGGGSGGGGSEIVMTQSPATLSLSPGERATLSCRA SQDISKYLNWYQQKPGQAPRLLIYHTSRLHSGIPARFS GSGSGTDYTLTISSLQPEDFAVYFCQQGNTLPYTFGQG TKLEIKTTTPAPRPPTPAPTIASQPLSLRPEACRPAAGG AVHTRGLDFACDIYIWAPLAGTCGVLLLSLVITLYCKR GRKKLLYIFKQPFMRPVQTTQEEDGCSCRFPEEEEGGC ELRVKFSRSADAPAYKQGQNQLYNELNLGRREEYDV LDKRRGRDPEMGGKPRRKNPQEGLYNELQKDKMAE AYSEIGMKGERRRGKGHDGLYQGLSTATKDTYDALH MQALPPR |

Humanized CAR12

| SEQ ID NO: 1070 | CAR12 scFv domain | QVQLQESGPGLVKPSETLSLTCTVSGVSLPDYGVSWIR QPPGKGLEWIGVIWGSETTYYNSSLKSRVTISKDNSKN QVSLKLSSVTAADTAVYYCAKHYYYGGSYAMDYWG QGTLVTVSSGGGGSGGGGSGGGGSEIVMTQSPATLSL |

TABLE 11-continued

CD19 CAR Constructs

| SEQ ID NUMBER | Region | Sequence |
|---|---|---|
| | | SPGERATLSCRASQDISKYLNWYQQKPGQAPRLLIYHT SRLHSGIPARFSGSGSGTDYTLTISSLQPEDFAVYFCQQ GNTLPYTFGQGTKLEIK |
| SEQ ID NO: 1071 | CAR 12-Full-aa | MALPVTALLLPLALLLHAARPEIVMTQSPATLSLSPGE RATLSCRASQDISKYLNWYQQKPGQAPRLLIYHTSRL HSGIPARFSGSGSGTDYTLTISSLQPEDFAVYFCQQGNT LPYTFGQGTKLEIKGGGGSGGGGSGGGGSQVQLQESG PGLVKPSETLSLTCTVSGVSLPDYGVSWIRQPPGKGLE WIGVIWGSETTYYNSSLKSRVTISKDNSKNQVSLKLSS VTAADTAVYYCAKHYYYGGSYAMDYWGQGTLVTVS STTTPAPRPPTPAPTIASQPLSLRPEACRPAAGGAVHTR GLDFACDIYIWAPLAGTCGVLLLSLVITLYCKRGRKKL LYIFKQPFMRPVQTTQEEDGCSCRFPEEEEGGCELRVK FSRSADAPAYKQGQNQLYNELNLGRREEYDVLDKRR GRDPEMGGKPRRKNPQEGLYNELQKDKMAEAYSEIG MKGERRRGKGHDGLYQGLSTATKDTYDALHMQALP PR |
| Murine CART19 | | |
| SEQ ID NO: 773 | HCDR1 (Kabat) | DYGVS |
| SEQ ID NO: 774 | HCDR2 (Kabat) | VIWGSETTYYNSALKS |
| SEQ ID NO: 775 | HCDR3 (Kabat) | HYYYGGSYAMDY |
| SEQ ID NO: 776 | LCDR1 (Kabat) | RASQDISKYLN |
| SEQ ID NO: 777 | LCDR2 (Kabat) | HTSRLHS |
| SEQ ID NO: 778 | LCDR3 (Kabat) | QQGNTLPYT |
| Humanized CART19 a | | |
| SEQ ID NO: 779 | HCDR1 (Kabat) | DYGVS |
| SEQ ID NO: 780 | HCDR2 (Kabat) | VIWGSETTYYSSSLKS |
| SEQ ID NO: 781 | HCDR3 (Kabat) | HYYYGGSYAMDY |
| SEQ ID NO: 782 | LCDR1 (Kabat) | RASQDISKYLN |
| SEQ ID NO: 783 | LCDR2 (Kabat) | HTSRLHS |
| SEQ ID NO: 784 | LCDR3 (Kabat) | QQGNTLPYT |
| Humanized CART19 b | | |
| SEQ ID NO: 785 | HCDR1 (Kabat) | DYGVS |
| SEQ ID NO: 786 | HCDR2 (Kabat) | VIWGSETTYYQSSLKS |
| SEQ ID NO: 787 | HCDR3 (Kabat) | HYYYGGSYAMDY |
| SEQ ID NO: 788 | LCDR1 (Kabat) | RASQDISKYLN |

TABLE 11-continued

CD19 CAR Constructs

| SEQ ID NUMBER | Region | Sequence |
|---|---|---|
| SEQ ID NO: 789 | LCDR2 (Kabat) | HTSRLHS |
| SEQ ID NO: 790 | LCDR3 (Kabat) | QQGNTLPYT |
| Humanized CART19 c | | |
| SEQ ID NO: 791 | HCDR1 (Kabat) | DYGVS |
| SEQ ID NO: 792 | HCDR2 (Kabat) | VIWGSETTYYNSSLKS |
| SEQ ID NO: 793 | HCDR3 (Kabat) | HYYYGGSYAMDY |
| SEQ ID NO: 794 | LCDR1 (Kabat) | RASQDISKYLN |
| SEQ ID NO: 795 | LCDR2 (Kabat) | HTSRLHS |
| SEQ ID NO: 796 | LCDR3 (Kabat) | QQGNTLPYT |

CD19 CAR constructs containing humanized anti-CD19 scFv domains are described in PCT publication WO 2014/153270, incorporated herein by reference.

The sequences of murine and humanized CDR sequences of the anti-CD19 scFv domains are shown in Table 12 for the heavy chain variable domains and in Table 13 for the light chain variable domains. The SEQ ID NO's refer to those found in Table 11. In some embodiments, the HCDR1 of a murine or humanized CD19 binding domain is GVSLP-DYGVS (SEQ ID NO: 1099).

TABLE 12

Heavy Chain Variable Domain CDR (Kabat) SEQ ID NO's of CD19 Antibodies

| Candidate | HCDR1 | HCDR2 | HCDR3 |
|---|---|---|---|
| murine_CART19 | 773 | 774 | 775 |
| humanized_CART19 a | 779 | 780 | 781 |
| humanized_CART19 b | 785 | 786 | 787 |
| humanized_CART19 c | 791 | 792 | 793 |

TABLE 13

Light Chain Variable Domain CDR (Kabat) SEQ ID NO's of CD19 Antibodies

| Candidate | LCDR1 | LCDR2 | LCDR3 |
|---|---|---|---|
| murine_CART19 | 776 | 777 | 778 |
| humanized_CART19 a | 782 | 783 | 784 |
| humanized_CART19 b | 788 | 789 | 790 |
| humanized_CART19 c | 794 | 795 | 796 |

General CAR Sequences

Sequences useful for generating CARs are provided below in Table 14.

TABLE 14

Sequences of CAR components

| SEQ ID NUMBER | Region | Sequence |
|---|---|---|
| SEQ ID NO: 797 | Leader amino acid sequence | MALPVTALLLPLALLLHAARP |
| SEQ ID NO: 798 | Leader nucleic acid sequence | ATGGCCCTCCCTGTCACCGCCCTGCTGCTTCCGCTGGCTCTTCTGCTCCACGCCGCTCGGCCC |
| SEQ ID NO: 799 | CD8 hinge amino acid sequence | TTTPAPRPPTPAPTIASQPLSLRPEACRPAAGGAVHTRGLDFACD |

TABLE 14-continued

Sequences of CAR components

| SEQ ID NUMBER | Region | Sequence |
|---|---|---|
| SEQ ID NO: 800 | CD8 hinge nucleic acid sequence | ACCACGACGCCAGCGCCGCGACCACCAACA CCGGCGCCCACCATCGCGTCGCAGCCCCTGT CCCTGCGCCCAGAGGCGTGCCGGCCAGCGGC GGGGGGGCGCAGTGCACACGAGGGGGCTGGA CTTCGCCTGTGAT |
| SEQ ID NO: 801 | CD8 transmembrane region (amino acid sequence) | IYIWAPLAGTCGVLLLSLVITLYC |
| SEQ ID NO: 802 | CD8 transmembrane (nucleic acid sequence) | ATCTACATTTGGGCCCCTCTGGCTGGTACTTG CGGGGTCCTGCTGCTTTCACTCGTGATCACTC TTTACTGT |
| SEQ ID NO: 1072 | CD8 Transmembrane (nucleic acid sequence) | ATCTACATCTGGGCGCCCTTGGCCGGGACTTGTG GGGTCCTTCTCCTGTCACTGGTTATCACCCTTTAC TGC |
| SEQ ID NO: 803 | 4-1BB Intracellular domain (amino acid sequence) | KRGRKKLLYIFKQPFMRPVQTTQEEDGCSCRFP EEEEGGCEL |
| SEQ ID NO: 804 | 4-1BB Intracellular domain (nucleic acid sequence) | AAGCGCGGTCGGAAGAAGCTGCTGTACATCT TTAAGCAACCCTTCATGAGGCCTGTGCAGAC TACTCAAGAGGAGGACGGCTGTTCATGCCGG TTCCCAGAGGAGGAGGAAGGCGGCTGCGAA CTG |
| SEQ ID NO: 1073 | 4-1BB intracellular domain (nucleic acid sequence) | AAACGGGGCAGAAAGAAACTCCTGTATATATTC AAACAACCATTTATGAGACCAGTACAAACTACTC AAGAGGAAGATGGCTGTAGCTGCCGATTTCCAG AAGAAGAAGAAGGAGGATGTGAACTG |
| SEQ ID NO: 805 | CD3 zeta domain (amino acid sequence) | RVKFSRSADAPAYKQGQNQLYNELNLGRREE YDVLDKRRGRDPEMGGKPRRKNPQEGLYNEL QKDKMAEAYSEIGMKGERRRGKGHDGLYQGL STATKDTYDALHMQALPPR |
| SEQ ID NO: 806 | CD3 zeta (nucleic acid sequence) | CGCGTGAAATTCAGCCGCAGCGCAGATGCTC CAGCCTACAAGCAGGGGCAGAACCAGCTCT ACAACGAACTCAATCTTGGTCGGAGAGAGG AGTACGACGTGCTGGACAAGCGGAGAGGAC GGGACCCAGAAATGGGCGGGAAGCCGCGCA GAAAGAATCCCCAAGAGGGCCTGTACAACG AGCTCCAAAAGGATAAGATGGCAGAAGCCT ATAGCGAGATTGGTATGAAAGGGGAACGCA GAAGAGGCAAAGGCCACGACGGACTGTACC AGGGACTCAGCACCGCCACCAAGGACACCT ATGACGCTCTTCACATGCAGGCCCTGCCGCC TCGG |
| SEQ ID NO: 1074 | CD3-zeta (na) (Q/K mutant) | AGAGTGAAGTTCAGCAGGAGCGCAGACGCCCCC GCGTACAAGCAGGGCCAGAACCAGCTCTATAAC GAGCTCAATCTAGGACGAAGAGAGGAGTACGAT GTTTTGGACAAGAGACGTGGCCGGGACCCTGAG ATGGGGGGAAAGCCGAGAAGGAAGAACCCTCAG GAAGGCCTGTACAATGAACTGCAGAAAGATAAG ATGGCGGAGGCCTACAGTGAGATTGGGATGAAA GGCGAGCGCCGGAGGGGCAAGGGGCACGATGGC CTTTACCAGGGTCTCAGTACAGCCACCAAGGACA CCTACGACGCCCTTCACATGCAGGCCCTGCCCCC TCGC |
| SEQ ID NO: 807 | CD3 zeta domain (amino acid sequence; NCBI Reference Sequence NM_000734.3) | RVKFSRSADAPAYQQGQNQLYNELNLGRREE YDVLDKRRGRDPEMGGKPRRKNPQEGLYNEL QKDKMAEAYSEIGMKGERRRGKGHDGLYQGL STATKDTYDALHMQALPPR |
| SEQ ID NO: 808 | CD3 zeta (nucleic acid sequence; | AGAGTGAAGTTCAGCAGGAGCGCAGACGCC CCCGCGTACCAGCAGGGCCAGAACCAGCTCT |

TABLE 14-continued

Sequences of CAR components

| SEQ ID NUMBER | Region | Sequence |
|---|---|---|
| | NCBI Reference Sequence NM_000734.3) | ATAACGAGCTCAATCTAGGACGAAGAGAGG AGTACGATGTTTTGGACAAGAGACGTGGCCG GGACCCTGAGATGGGGGGAAAGCCGAGAAG GAAGAACCCTCAGGAAGGCCTGTACAATGA ACTGCAGAAAGATAAGATGGCGGAGGCCTA CAGTGAGATTGGGATGAAAGGCGAGCGCCG GAGGGGCAAGGGGCACGATGGCCTTTACCA GGGTCTCAGTACAGCCACCAAGGACACCTAC GACGCCCTTCACATGCAGGCCCTGCCCCCTC GC |
| SEQ ID NO: 809 | CD28 DOMAIN (AMINO ACID SEQUENCE) | RSKRSRLLHSDYMNMTPRRPGPTRKHYQPYAP PRDFAAYRS |
| SEQ ID NO: 810 | CD28 DOMAIN (NUCLEIC ACID SEQUENCE) | AGGAGTAAGAGGAGCAGGCTCCTGCACAGT GACTACATGAACATGACTCCCCGCCGCCCCG GGCCCACCCGCAAGCATTACCAGCCCTATGC CCCACCACGCGACTTCGCAGCCTATCGCTCC |
| SEQ ID NO: 811 | WILD-TYPE ICOS DOMAIN (AMINO ACID SEQUENCE) | TKKKYSSSVHDPNGEYMFMRAVNTAKKSRLT DVTL |
| SEQ ID NO: 812 | WILD-TYPE ICOS DOMAIN (NUCLEOTIDE SEQUENCE) | ACAAAAAAGAAGTATTCATCCAGTGTGCACG ACCCTAACGGTGAATACATGTTCATGAGAGC AGTGAACACAGCCAAAAAATCCAGACTCAC AGATGTGACCCTA |
| SEQ ID NO: 813 | Y TO F MUTANT ICOS DOMAIN (AMINO ACID SEQUENCE) | TKKKYSSSVHDPNGEFMFMRAVNTAKKSRLT DVTL |
| SEQ ID NO: 814 | IgG4 Hinge (amino acid sequence) | ESKYGPPCPPCPAPEFLGGPSVFLFPPKPKDTLM ISRTPEVTCVVVDVSQEDPEVQFNWYVDGVEV HNAKTKPREEQFNSTYRVVSVLTVLHQDWLN GKEYKCKVSNKGLPSSIEKTISKAKGQPREPQV YTLPPSQEEMTKNQVSLTCLVKGFYPSDIAVE WESNGQPENNYKTTPPVLDSDGSFFLYSRLTV DKSRWQEGNVFSCSVMHEALHNHYTQKSLSL SLGKM |
| SEQ ID NO: 815 | IgG4 Hinge (nucleic acid sequence) | GAGAGCAAGTACGGCCCTCCCTGCCCCCCTT GCCCTGCCCCCGAGTTCCTGGGCGGACCCAG CGTGTTCCTGTTCCCCCCCAAGCCCAAGGAC ACCCTGATGATCAGCCGGACCCCCGAGGTGA CCTGTGTGGTGGTGGACGTGTCCCAGGAGGA CCCCGAGGTCCAGTTCAACTGGTACGTGGAC GGCGTGGAGGTGCACAACGCCAAGACCAAG CCCCGGGAGGAGCAGTTCAATAGCACCTACC GGGTGGTGTCCGTGCTGACCGTGCTGCACCA GGACTGGCTGAACGGCAAGGAATACAAGTG TAAGGTGTCCAACAAGGGCCTGCCCAGCAGC ATCGAGAAAACCATCAGCAAGGCCAAGGGC CAGCCTCGGGAGCCCCAGGTGTACACCCTGC CCCCTAGCCAAGAGGAGATGACCAAGAACC AGGTGTCCCTGACCTGCCTGGTGAAGGGCTT CTACCCCAGCGACATCGCCGTGGAGTGGGAG AGCAACGGCCAGCCCGAGAACAACTACAAG ACCACCCCCCCTGTGCTGGACAGCGACGGCA GCTTCTTCCTGTACAGCCGGCTGACCGTGGA CAAGAGCCGGTGGCAGGAGGGCAACGTCTTT AGCTGCTCCGTGATGCACGAGGCCCTGCACA ACCACTACACCCAGAAGAGCCTGAGCCTGTC CCTGGGCAAGATG |
| SEQ ID NO: 816 | IgD hinge (amino acid sequence) | RWPESPKAQASSVPTAQPQAEGSLAKATTAPA TTRNTGRGGEEKKKEKEKEEQEERETKTPECPS HTQPLGVYLLTPAVQDLWLRDKATFTCFVVGS DLKDAHLTWEVAGKVPTGGVEEGLLERHSNG SQSQHSRLTLPRSLWNAGTSVTCTLNHPSLPPQ RLMALREPAAQAPVKLSLNLLASSDPPEAASW LLCEVSGFSPPNILLMWLEDQREVNTSGFAPAR |

TABLE 14-continued

Sequences of CAR components

| SEQ ID NUMBER | Region | Sequence |
|---|---|---|
| | | PPPQPGSTTFWAWSVLRVPAPPSPQPATYTCVV SHEDSRTLLNASRSLEVSYVTDH |
| SEQ ID NO: 817 | IgD hinge (nucleic acid sequence) | AGGTGGCCCGAAAGTCCCAAGGCCCAGGCA TCTAGTGTTCCTACTGCACAGCCCCAGGCAG AAGGCAGCCTAGCCAAAGCTACTACTGCACC TGCCACTACGCGCAATACTGGCCGTGGCGGG GAGGAGAAGAAAAAGGAGAAAGAGAAAGA AGAACAGGAAGAGAGGGAGACCAAGACCCC TGAATGTCCATCCCATACCCAGCCGCTGGGC GTCTATCTCTTGACTCCCGCAGTACAGGACTT GTGGCTTAGAGATAAGGCCACCTTTACATGT TTCGTCGTGGGCTCTGACCTGAAGGATGCCC ATTTGACTTGGGAGGTTGCCGGAAAGGTACC CACAGGGGGGTTGAGGAAGGGTTGCTGGA GCGCCATTCCAATGGCTCTCAGAGCCAGCAC TCAAGACTCACCCTTCCGAGATCCCTGTGGA ACGCCGGGACCTCTGTCACATGTACTCTAAA TCATCCTAGCCTGCCCCCACAGCGTCTGATG GCCCTTAGAGAGCCAGCCGCCCAGGCACCAG TTAAGCTTAGCCTGAATCTGCTCGCCAGTAG TGATCCCCAGAGGCCGCCAGCTGGCTCTTA TGCGAAGTGTCCGGCTTTAGCCCGCCCAACA TCTTGCTCATGTGGCTGGAGGACCAGCGAGA AGTGAACACCAGCGGCTTCGCTCCAGCCCGG CCCCCACCCCAGCCGGGTTCTACCACATTCT GGGCCTGGAGTGTCTTAAGGGTCCCAGCACC ACCTAGCCCCCAGCCAGCCACATACACCTGT GTTGTGTCCCATGAAGATAGCAGGACCCTGC TAAATGCTTCTAGGAGTCTGGAGGTTTCCTA CGTGACTGACCATT |
| SEQ ID NO: 818 | CD27 signalling domain (amino acid) | QRRKYRSNKGESPVEPAEPCRYSCPREEEGSTI PIQEDYRKPEPACSP |
| SEQ ID NO: 819 | CD27 signalling domain (nucleic acid sequence) | AGGAGTAAGAGGAGCAGGCTCCTGCACAGT GACTACATGAACATGACTCCCCGCCGCCCCG GGCCCACCCGCAAGCATTACCAGCCCTATGC CCCACCACGCGACTTCGCAGCCTATCGCTCC |
| SEQ ID NO: 820 | Extracellular domain of PD1 (amino acid sequence) | PGWFLDSPDRPWNPPTFSPALLVVTEGDNATF TCSFSNTSESFVLNWYRMSPSNQTDKLAAFPE DRSQPGQDCRFRVTQLPNGRDFHMSVVRARR NDSGTYLCGAISLAPKAQIKESLRAELRVTERR AEVPTAHPSPSPRPAGQFQTLV |
| SEQ ID NO: 821 | Extracellular domain of PD1 (nucleic acid sequence) | CCCGGATGGTTTCTGGACTCTCCGGATCGCC CGTGGAATCCCCCAACCTTCTCACCGGCACT CTTGGTTGTGACTGAGGGCGATAATGCGACC TTCACGTGCTCGTTCTCCAACACCTCCGAATC ATTCGTGCTGAACTGGTACCGCATGAGCCCG TCAAACCAGACCGACAAGCTCGCCGCGTTTC CGGAAGATCGGTCGCAACCGGGACAGGATT GTCGGTTCCGCGTGACTCAACTGCCGAATGG CAGAGACTTCCACATGAGCGTGGTCCGCGCT AGGCGAAACGACTCCGGGACCTACCTGTGCG GAGCCATCTCGCTGGCGCCTAAGGCCCAAAT CAAAGAGAGCTTGAGGGCCGAACTGAGAGT GACCGAGCGCAGAGCTGAGGTGCAACTGC ACATCCATCCCATCGCCTCGGCCTGCGGGG CAGTTTCAGACCCTGGTC |
| SEQ ID NO: 822 | PD1 CAR amino acid sequence | PGWFLDSPDRPWNPPTFSPALLVVTEGDNATF TCSFSNTSESFVLNWYRMSPSNQTDKLAAFPE DRSQPGQDCRFRVTQLPNGRDFHMSVVRARR NDSGTYLCGAISLAPKAQIKESLRAELRVTERR AEVPTAHPSPSPRPAGQFQTLVTTTPAPRPPTPA PTIASQPLSLRPEACRPAAGGAVHTRGLDFACD IYIWAPLAGTCGVLLLSLVITLYCKRGRKKLLY IFKQPFMRPVQTTQEEDGCSCRFPEEEEGGCEL RVKFSRSADAPAYKQGQNQLYNELNLGRREE YDVLDKRRGRDPEMGGKPRRKNPQEGLYNEL QKDKMAEAYSEIGMKGERRRGKGHDGLYQGL STATKDTYDALHMQALPPR |

TABLE 14-continued

Sequences of CAR components

| SEQ ID NUMBER | Region | Sequence |
|---|---|---|
| SEQ ID NO: 823 | PD1 CAR (nucleic acid sequence) | CCCGGATGGTTTCTGGACTCTCCGGATCGCC CGTGGAATCCCCCAACCTTCTCACCGGCACT CTTGGTTGTGACTGAGGGCGATAATGCGACC TTCACGTGCTCGTTCTCCAACACCTCCGAATC ATTCGTGCTGAACTGGTACCGCATGAGCCCG TCAAACCAGACCGACAAGCTCGCCGCGTTTC CGGAAGATCGGTCGCAACCGGGACAGGATT GTCGGTTCCGCGTGACTCAACTGCCGAATGG CAGAGACTTCCACATGAGCGTGGTCCGCGCT AGGCGAAACGACTCCGGGACCTACCTGTGCG GAGCCATCTCGCTGGCGCCTAAGGCCCAAAT CAAAGAGAGCTTGAGGGCCGAACTGAGAGT GACCGAGCGCAGAGCTGAGGTGCCAACTGC ACATCCATCCCATCGCCTCGGCCTGCGGGG CAGTTTCAGACCCTGGTCACGACCACTCCGG CGCCGCGCCCACCGACTCCGGCCCCAACTAT CGCGAGCCAGCCCCTGTCGCTGAGGCCGGAA GCATGCCGCCCTGCCGCCGGAGGTGCTGTGC ATACCCGGGGATTGGACTTCGCATGCGACAT CTACATTTGGGCTCCTCTCGCCGGAACTTGTG GCGTGCTCCTTCTGTCCCTGGTCATCACCCTG TACTGCAAGCGGGGTCGGAAAAAGCTTCTGT ACATTTTCAAGCAGCCCTTCATGAGGCCCGT GCAAACCACCCAGGAGGAGGACGGTTGCTC CTGCCGGTTCCCCGAAGAGGAAGAAGGAGG TTGCGAGCTGCGCGTGAAGTTCTCCCGGAGC GCCGACGCCCCCGCCTATAAGCAGGGCCAGA ACCAGCTGTACAACGAACTGAACCTGGGACG GCGGGAAGAGTACGATGTGCTGGACAAGCG GCGCGGCCGGGACCCCGAAATGGGCGGGAA GCCTAGAAGAAAGAACCCTCAGGAAGGCCT GTATAACGAGCTGCAGAAGGACAAGATGGC CGAGGCCTACTCCGAAATTGGGATGAAGGG AGAGCGGCGGAGGGGAAAGGGGCACGACGG CCTGTACCAAGGACTGTCCACCGCCACCAAG GACACATACGATGCCCTGCACATGCAGGCCC TTCCCCCTCGC |
| FKBP | | |
| SEQ ID NO: 824 | FKBP full amino acid sequence | DVPDYASLGGPSSPKKKRKVSRGVQVETISPG DGRTFPKRGQTCVVHYTGMLEDGKKFDSSRD RNKPFKFMLGKQEVIRGWEEGVAQMSVGQRA KLTISPDYAYGATGHPGIIPPHATLVFDVELLKL ETSY |
| SEQ ID NO: 825 | FKBP fragment amino acid sequence | VQVETISPGDGRTFPKRGQTCVVHYTGMLEDG KKFDSSRDRNKPFKFMLGKQEVIRGWEEGVA QMSVGQRAKLTISPDYAYGATGHPGIIPPHATL VFDVELLKLETS |
| SEQ ID NO: 826 | FRB | ILWHEMWHEGLEEASRLYFGERNVKGMFEVL EPLHAMMERGPQTLKETSFNQAYGRDLMEAQ EWCRKYMKSGNVKDLTQAWDLYYHVFRRISK |
| FRB mutants | | |
| SEQ ID NO: 827 | E2032I mutant | ILWHEMWHEGLIEASRLYFGERNVKGMFEVLE PLHAMMERGPQTLKETSFNQAYGRDLMEAQE WCRKYMKSGNVKDLTQAWDLYYHVFRRISKTS |
| SEQ ID NO: 828 | E2032L mutant | ILWHEMWHEGLLEASRLYFGERNVKGMFEVL EPLHAMMERGPQTLKETSFNQAYGRDLMEAQ EWCRKYMKSGNVKDLTQAWDLYYHVFRRISK TS |
| SEQ ID NO: 829 | T2098L mutant | ILWHEMWHEGLEEASRLYFGERNVKGMFEVL EPLHAMMERGPQTLKETSFNQAYGRDLMEAQ EWCRKYMKSGNVKDLLQAWDLYYHVFRRISK TS |
| SEQ ID NO: 830 | E2032, T2098 mutant | ILWHEMWHEGLXEASRLYFGERNVKGMFEVL EPLHAMMERGPQTLKETSFNQAYGRDLMEAQ |

TABLE 14-continued

Sequences of CAR components

| SEQ ID NUMBER | Region | Sequence |
|---|---|---|
| | | EWCRKYMKSGNVKDLXQAWDLYYHVFRRIS KTS |
| SEQ ID NO: 831 | E2032I, T2098L mutant | ILWHEMWHEGLIEASRLYFGERNVKGMFEVLE PLHAMMERGPQTLKETSFNQAYGRDLMEAQE WCRKYMKSGNVKDLLQAWDLYYHVFRRISKTS |
| SEQ ID NO: 832 | E2032L, T2098L mutant | ILWHEMWHEGLLEASRLYFGERNVKGMFEVL EPLHAMMERGPQTLKETSFNQAYGRDLMEAQ EWCRKYMKSGNVKDLLQAWDLYYHVFRRISK TS |

EF1 alpha promoter

| SEQ ID NO: 833 | EF1 alpha promoter nucleic acid sequence | CGTGAGGCTCCGGTGCCCGTCAGTGGGCAGA GCGCACATCGCCCACAGTCCCCGAGAAGTTG GGGGGAGGGGTCGGCAATTGAACCGGTGCC TAGAGAAGGTGGCGCGGGGTAAACTGGGAA AGTGATGTCGTGTACTGGCTCCGCCTTTTCC CGAGGGTGGGGGAGAACCGTATATAAGTGC AGTAGTCGCCGTGAACGTTCTTTTTCGCAAC GGGTTTGCCGCCAGAACACAGGTAAGTGCCG TGTGTGGTTCCCGCGGGCCTGGCCTCTTTACG GGTTATGGCCCTTGCGTGCCTTGAATTACTTC CACCTGGCTGCAGTACGTGATTCTTGATCCC GAGCTTCGGGTTGGAAGTGGGTGGGAGAGTT CGAGGCCTTGCGCTTAAGGAGCCCCTTCGCC TCGTGCTTGAGTTGAGGCCTGGCCTGGGCGC TGGGGCCGCCGCGTGCGAATCTGGTGGCACC TTCGCGCCTGTCTCGCTGCTTTCGATAAGTCT CTAGCCATTTAAAATTTTTGATGACCTGCTGC GACGCTTTTTTTCTGGCAAGATAGTCTTGTAA ATGCGGGCCAAGATCTGCACACTGGTATTTC GGTTTTTGGGGCCGCGGGCGGCGACGGGGCC CGTGCGTCCCAGCGCACATGTTCGGCGAGGC GGGGCCTGCGAGCGCGGCCACCGAGAATCG GACGGGGGTAGTCTCAAGCTGGCCGGCCTGC TCTGGTGCCTGGCCTCGCGCCGCCGTGTATC GCCCCGCCCTGGGCGGCAAGGCTGGCCCGGT CGGCACCAGTTGCGTGAGCGGAAAGATGGC CGCTTCCCGGCCCTGCTGCAGGGAGCTCAAA ATGGAGGACGCGGCGCTCGGGAGAGCGGGC GGGTGAGTCACCCACACAAAGGAAAAGGGC CTTTCCGTCCTCAGCCGTCGCTTCATGTGACT CCACGGAGTACCGGGCGCCGTCCAGGCACCT CGATTAGTTCTCGAGCTTTTGGAGTACGTCGT CTTTAGGTTGGGGGGAGGGGTTTTATGCGAT GGAGTTTCCCCACACTGAGTGGGTGGAGACT GAAGTTAGGCCAGCTTGGCACTTGATGTAAT TCTCCTTGGAATTTGCCCTTTTTGAGTTTGGA TCTTGGTTCATTCTCAAGCCTCAGACAGTGGT TCAAAGTTTTTTCTTCCATTTCAGGTGTCGT GA |

Linker

| SEQ ID NO: 834 | G4S subunit | GGGGS |
| SEQ ID NO: 838 | Linker | LAEAAAK |

CD19 and CD22 Tandem CAR Constructs

Tandem CARs comprising two distinct scFvs that target CD19 and CD22 were generated. The generated anti-CD19 scFv and anti-CD22 scFv constructs included two different linkers: LAEAAAK (SEQ ID NO: 838) and GGGGS (SEQ ID NO: 1083). The generation and evaluation of the tandem CARs is further described in Example 13. The sequences of the single CARs targeting CD22 and CD19 are provided below in Table 15.

TABLE 15

Amino acid and nucleic acid sequences of single CARs targeting CD22 and CD19.

| SEQ ID NO: | CD19/CD22 CAR Construct | Sequence |
|---|---|---|
| SEQ ID NO: 844 | Construct 171 (nucleic acid sequence) | atggccctccctgtcaccgccctgctgcttccgctggctcttc tgctccacgccgctcggcccgaaattgtgatgacccagtca cccgccactcttagccttcacccggtgagcgcgcaaccctg tcttgcagagcctcccaagacatctcaaaataccttaattggt atcaacagaagcccggacaggctcctcgccttctgatctacc acaccagccggctccattctggaatccctgcaggttcagc ggtagcggatctgggaccgactacaccctcactatcagctc actgcagccagaggacttcgctgtctatttctgtcagcaagg gaacaccctgccctacacctttggacagggcaccaagctcg agattaaaggtggaggtggcagcggaggaggtgggtccg gcggtggaggaagccaggtccaactccaagaaagcggac cgggtcttgtgaagccatcagaaactctttcactgacttgtact gtgagcggagtgtctctccccgattacggggtgtcttggatc agacagccaccggggaagggtctggaatggattggagtga tttggggctctgagactacttactaccaatcatccctcaagtca cgcgtcaccatctcaaaggacaactctaagaatcaggtgtca ctgaaactgtcatctgtgaccgcagccgacaccgccgtgta ctattgcgctaagcattactattatggcgggagctacgcaatg gattactggggacagggtactctggtcaccgtgtccagcttg gcagaagccgccgcgaaagaagtgcagcttcaacaatcag gaccaggactcgtcaaaccatcacagaccctctccctcacat gtgccatctccggggactccatgttgagcaattccgacactt ggaattggattagacaaagcccgtcccggggtctggaatgg ttgggacgcacctaccaccggtctacttggtacgacgactac gcgtcatccgtgcggggaagagtgtccatcaacgtggacac ctccaagaaccagtacagcctgcagcttaatgccgtgactcc tgaggatacgggcgtctactactgcgcccgcgtccgcctgc aagacgggaacagctggagcgatgcattcgatgtctgggg ccagggaactatggtcaccgtgtcgtctgggggcggtggat cgggtggcgggggttcggggggcggcggctctcagtccg ctcttacccaaccggcctcagcctcggggagccccggcca gagcgtgaccatttcctgcaccggcacttcatccgacgtggg cggctacaactacgtgtcctggtaccaacagcacccgggaa aggcccccaagctcatgatctacgacgtgtccaacaggccc tcgggagtgtccaaccggttctcgggttcgaaatcgggaaa cacagccagcctgaccatcagcggactgcaggctgaagat gaagccgactactactgctcctcctacacctcgtcatccacg ctctacgtgttcggcactggaactcagctgactgtgctgacc actaccccagcaccgaggccaccccccccggctcctacca tcgcctcccagcctctgtccctgcgtccggaggcatgtagac ccgcagctggtggggccgtgcatacccggggtcttgacttc gcctgcgatatctacatttgggccctctggctggtacttgcg gggtcctgctgctttcactcgtgatcactcttttactgtaagcgc ggtcggaagaagctgctgtacatctttaagcaacccttcatga ggcctgtgcagactactcaagaggaggacggctgttcatgc cggttcccagaggaggaggaaggcggctgcgaactgcgc gtgaaattcagccgcagcgcagatgctccagcctaccagca ggggcagaaccagctctacaacgaactcaatcttggtcgga gagaggagtacgacgtgctggacaagcggagaggacgg gacccagaaatgggcgggaagccgcgcagaaagaatccc caagagggcctgtacaacgagctccaaaaggataagatgg cagaagcctatagcgagattggtatgaaggggaacgcag aagaggcaaaggccacgacggactgtaccagggactcag caccgccaccaaggacacctatgacgctcttcacatgcagg ccctgccgcctcggtaa |
| SEQ ID NO: 845 | Construct 171 (amino acid sequence) | MALPVTALLLPLALLLHAARPEIVMTQ SPATLSLSPGERATLSCRASQDISKYLN WYQQKPGQAPRLLIYHTSRLHSGIPAR FSGSGSGTDYTLTISSLQPEDFAVYFCQ QGNTLPYTFGQGTKLEIKGGGGSGGG GSGGGGSQVQLQESGPGLVKPSETLSL TCTVSGVSLPDYGVSWIRQPPGKGLE WIGVIWGSETTYYQSSLKSRVTISKDN SKNQVSLKLSSVTAADTAVYYCAKHY YYGGSYAMDYWGQGTLVTVS*SLAEAA AK*EVQLQQSGPGLVKPSQTLSLTCAISG DSMLSNSDTWNWIRQSPSRGLEWLGR TYHRSTWYDDYASSVRGRVSINVDTS KNQYSLQLNAVTPEDTGVYYCARVRL QDGNSWSDAFDVWGQGTMVTVSSGG GGSGGGGSGGGSQSALTQPASASGSP GQSVTISCTGTSSDVGGYNYVSWYQQ HPGKAPKLMIYDVSNRPSGVSNRFSGS KSGNTASLTISGLQAEDEADYYCSSYT |

TABLE 15-continued

Amino acid and nucleic acid sequences of single CARs targeting CD22 and CD19.

|  |  |
|---|---|
|  | SSSTLYVFGTGTQLTVLTTTPAPRPPTP APTIASQPLSLRPEACRPAAGGAVHTR GLDFACDIYIWAPLAGTCGVLLLSLVIT LYCKRGRKKLLYIFKQPFMRPVQTTQE EDGCSCRFPEEEEGGCELRVKFSRSAD APAYQQGQNQLYNELNLGRREEYDVL DKRRGRDPEMGGKPRRKNPQEGLYNE LQKDKMAEAYSEIGMKGERRRGKGH DGLYQGLSTATKDTYDALHMQALPPR |
| SEQ ID NO: 846 Construct 172 (nucleic acid sequence) | atggccctccctgtcaccgccctgctgcttccgctggctcttc tgctccacgccgctcggcccgaaattgtgatgacccagtca cccgccactcttagcctttcacccggtgagcgcgcaaccctg tcttgcagagcctcccaagacatctcaaataccttaattggt atcaacagaagcccggacaggctcctcgccttctgatctacc acaccagccggctccattctggaatccctgccaggttcagc ggtagcggatctgggaccgactacaccctcactatcagctc actgcagccagaggacttcgctgtctatttctgtcagcaagg gaacaccctgccctacacctttggacagggcaccaagctcg agattaaaggtggaggtggcagcggaggaggtgggtccg gcggtggaggaagccaggtccaactccaagaaagcggac cgggtcttgtgaagccatcagaaactctttcactgacttgtact gtgagcggagtgtctctccccgattacggggtgtcttggatc agacagccaccggggaagggtctggaatggattggagtga tttggggctctgagactacttactaccaatcatccctcaagtca cgcgtcaccatctcaaaggacaactctaagaatcaggtgtca ctgaaactgtcatctgtgaccgcagccgacaccgccgtgta ctattgcgctaagcattactattatggcgggagctacgcaatg gattactggggacagggtactctggtcaccgtgtccagcgg agggggagggagtgaagtgcagcttcaacaatcaggacca ggactcgtcaaaccatcacagaccctctccctcacatgtgcc atctccggggactccatgttgagcaattccgacacttggaatt ggattagacaaagcccgtcccggggtctggaatggttggga cgcacctaccaccggtctacttggtacgacgactacgcgtca tccgtgcggggaagagtgtccatcaacgtggacacctccaa gaaccagtacagcctgcagcttaatgccgtgactcctgagg atacgggcgtctactactgcgcccgcgtccgcctgcaagac gggaacagctggagcgatgcattcgatgtctggggccagg gaactatggtcaccgtgtcgtctggggcggtggatcgggt ggcggggttcgggggcggcggctctcagtccgctctta cccaaccggcctcagcctcggggagccccggccagagcg tgaccatttcctgcaccggcacttcatccgacgtgggcggct acaactacgtgtcctggtaccaacagcacccgggaaaggc ccccaagctcatgatctacgacgtgtccaacaggccctcgg gagtgtccaaccggttctcggggttcgaaatcgggaaacaca gccagcctgaccatcagcggactgcaggctgaagatgaag ccgactactactgctcctcctacacctcgtcatccacgctcta cgtgttcggcactggaactcagctgactgtgctgaccactac cccagcaccgaggccacccaccccggctcctaccatcgcc tcccagcctctgtccctgcgtccggaggcatgtagacccgc agctggtggggccgtgcataccggggtcttgacttcgcct gcgatatctacatttgggccctctggctggtacttgcgggt cctgctgctttcactcgtgatcactctttactgtaagcgcggtc ggaagaagctgctgtacatcttaagcaaccttcatgaggc ctgtgcagactactcaagaggaggacggctgttcatgccgg ttcccagaggaggaggaaggcggctgcgaactgcgcgtg aaattcagccgcagcgcagatgctccagcctaccagcagg ggcagaaccagctctacaacgaactcaatcttggtcggaga gaggagtacgacgtgctggacaagcgggagaggacgggac ccagaaatgggcgggaagccgcgcagaaagaatcccaa gagggcctgtacaacgagctccaaaaggataagatggcag aagcctatagcgagattggtatgaaaggggaacgcagaag aggcaaaggccacgacggactgtaccagggactcagcac cgccaccaaggacacctatgacgctcttcacatgcaggccc tgccgcctcggtaa |
| SEQ ID NO: 847 Construct 172 (amino acid sequence) | MALPVTALLLPLALLLHAARPEIVMTQ SPATLSLSPGERATLSCRASQDISKYLN WYQQKPGQAPRLLIYHTSRLHSGIPAR FSGSGSGTDYTLTISSLQPEDFAVYFCQ QGNTLPYTFGQGTKLEIKGGGGSGGG GSGGGGSQVQLQESGPGLVKPSETLSL TCTVSGVSLPDYGVSWIRQPPGKGLE WIGVIWGSETTYYQSSLKSRVTISKDN SKNQVSLKLSSVTAADTAVYYCAKHY YYGGSYAMDYWGQGTLVTVSSGGGG SEVQLQQSGPGLVKPSQTLSLTCAISGD SMLSNSDTWNWIRQSPSRGLEWLGRT |

TABLE 15-continued

Amino acid and nucleic acid sequences of single CARs targeting CD22 and CD19.

|  |  |  |
| --- | --- | --- |
|  |  | YHRSTWYDDYASSVRGRVSINTVDTSK<br>NQYSLQLNAVTPEDTGVYYCARVRLQ<br>DGNSWSDAFDVWGQGTMVTVSSGGG<br>GSGGGGSGGGGSQSALTQPASASGSPG<br>QSVTISCTGTSSDVGGYNYVSWYQQH<br>PGKAPKLMIYDVSNRPSGVSNRFSGSK<br>SGNTASLTISGLQAEDEADYYCSSYTSS<br>STLYVFGTGTQLTVLTTTPAPRPPTPAP<br>TIASQPLSLRPEACRPAAGGAVHTRGL<br>DFACDIYIWAPLAGTCGVLLLSLVITLY<br>CKRGRKKLLYIFKQPFMRPVQTTQEED<br>GCSCRFPEEEEGGCELRVKFSRSADAP<br>AYQQGQNQLYNELNLGRREEYDVLD<br>KRRGRDPEMGGKPRRKNPQEGLYNEL<br>QKDKMAEAYSEIGMKGERRRGKGHD<br>GLYQGLSTATKDTYDALHMQALPPR* |
| SEQ ID NO: 848 | Construct 173<br>(nucleic acid<br>sequence) | atggcctccctgtcaccgcctgctgcttccgctggctcttc<br>tgctccacgccgctcggcccgaaattgtgatgacccagtca<br>cccgccactcttagccttcacccggtgagcgcgcaaccctg<br>tcttgcagagcctcccaagacatctcaaaatacctaattggt<br>atcaacagaagcccggacaggctcctcgccttctgatctacc<br>acaccagccggctccattctggaatccctgccaggttcagc<br>ggtagcggatctgggaccgactacaccctcactatcagctc<br>actgcagccagaggacttcgctgtctatttctgtcagcaagg<br>gaacaccctgccctacacctttggacagggcaccaagctcg<br>agattaaaggtggaggtggcagcggaggaggtgggtccg<br>gcggtggaggaagccaggtccaactccaagaaagcggac<br>cgggtcttgtgaagccatcagaaactctttcactgacttgtact<br>gtgagcggagtgtctctccccgattacggggtgtcttggatc<br>agacagccaccggggaagggtctggaatggattggagtga<br>tttggggctctgagactacttactaccaatcatccctcaagtca<br>cgcgtcaccatctcaaaggacaactctaagaatcaggtgtca<br>ctgaaactgtcatctgtgaccgcagccgacaccgccgtgta<br>ctattgcgctaagcattactattatggcgggagctacgcaatg<br>gattactggggacagggtactctggtcaccgtgtccagcttg<br>gcagaagccgccgcgaaagaagtgcagcttcaacaatcag<br>gaccaggactcgtcaaaccatcacagaccctctccctcacat<br>gtgccatctccggggactccatgttgagcaattccgacactt<br>ggaattggattagacaaagcccgtcccggggtctggaatgg<br>ttgggacgcacctaccaccggtctacttggtacgacgactac<br>gcgtcatccgtgcgggaagagtgtccatcaacgtggacac<br>ctccaagaaccagtacgcctgcagcttaatgccgtgactcc<br>tgaggatacgggcgtctactactgcgcccgcgtccgcctgc<br>aagacgggaacagctggagcgatgcattcgatgtctgggg<br>ccagggaactatggtcaccgtgtcgtctggcggaggaggct<br>cccagtccgctcttacccaaccggcctcagcctcggggagc<br>cccggccagagcgtgaccatttcctgcaccggcacttcatcc<br>gacgtgggcggctacaactacgtgtcctggtaccaacagca<br>cccgggaaaggcccccaagctcatgatctacgacgtgtcca<br>acaggccctcgggagtgtccaaccggttctcgggttcgaaa<br>tcgggaaacacagccagcctgaccatcagcggactgcagg<br>ctgaagatgaagccgactactactgctcctcctacacctcgtc<br>atccacgctctacgtgttcggcactggaactcagctgactgt<br>gctgaccactaccccagcaccgaggccacccacccccggct<br>cctaccatcgcctcccagcctctgtccctgcgtccggaggca<br>tgtagacccgcagctggtggggccgtgcataccccgggtct<br>tgacttcgcctgcgatatctacatttgggcccctctggctggta<br>cttgcggggtcctgctgcttcactcgtgatcactcttactgta<br>agcgcggtcggaagaagctgctgtacatctttaagcaaccct<br>tcatgaggcctgtgcagactactcaagaggaggacggctgt<br>tcatgccggttcccagaggaggaggaaggcggctgcgaac<br>tgcgcgtgaaattcagccgcagcgcagatgctccagcctac<br>cagcagggcagaaccagctctacaacgaactcaatcttgg<br>tcggagagaggagtacgacgtgctggacaagcggagagg<br>acgggacccagaaatgggcgggaagccgcgcagaaaga<br>atccccaagagggcctgtacaacgagctccaaaaggataa<br>gatggcagaagcctatagcgagattggtatgaaagggaa<br>cgcagaagaggcaaaggccacgacggactgtaccaggga<br>ctcagcaccgccaccaaggacacctatgacgctcttcacat<br>gcaggccctgccgcctcggtaa |
| SEQ ID NO: 849 | Construct 173<br>(amino acid<br>sequence) | MALPVTALLLPLALLLHAARPEIVMTQ<br>SPATLSLSPGERATLSCRASQDISKYLN<br>WYQQKPGQAPRLLIYHTSRLHSGIPAR<br>FSGSGSGTDYTLTISSLQPEDFAVYFCQ<br>QGNTLPYTFGQGTKLEIKGGGGSGGG<br>GSGGGGSQVQLQESGPGLVKPSETLSL |

TABLE 15-continued

Amino acid and nucleic acid sequences of single CARs targeting CD22 and CD19.

| | | |
|---|---|---|
| | | TCTVSGVSLPDYGVSWIRQPPGKGLE<br>WIGVIWGSETTYYQSSLKSRVTISKDN<br>SKNQVSLKLSSVTAADTAVYYCAKHY<br>YYGGSYAMDYWGQGTLVTVS*SLAEAA*<br>*AK*EVQLQQSGPGLVKPSQTLSLTCAISG<br>DSMLSNSDTWNWIRQSPSRGLEWLGR<br>TYHRSTWYDDYASSVRGRVSINVDTS<br>KNQYSLQLNAVTPEDTGVYYCARVRL<br>QDGNSWSDAFDVWGQGTMVTVSSGG<br>GGSQSALTQPASASGSPGQSVTISCTGT<br>SSDVGGYNYVSWYQQHPGKAPKLMIY<br>DVSNRPSGVSNRFSGSKSGNTASLTISG<br>LQAEDEADYYCSSYTSSSTLYVFGTGT<br>QLTVLTTTPAPRPPTPAPTIASQPLSLRP<br>EACRPAAGGAVHTRGLDFACDIYIWA<br>PLAGTCGVLLLSLVITLYCKRGRKKLL<br>YIFKQPFMRPVQTTQEEDGCSCRFPEEE<br>EGGCELRVKFSRSADAPAYQQGQNQL<br>YNELNLGRREEYDVLDKRRGRDPEMG<br>GKPRRKNPQEGLYNELQKDKMAEAYS<br>EIGMKGERRRGKGHDGLYQGLSTATK<br>DTYDALHMQALPPR |
| SEQ ID NO: 850 | Construct 174<br>(nucleic acid<br>sequence) | atggccctccctgtcaccgccctgctgcttccgctggctcttc<br>tgctccacgccgctcggcccgaaattgtgatgacccagtca<br>cccgccactcttagcctttcaccggtgagcgcgcaaccctg<br>tcttgcagagcctcccaagacatctcaaaataccttaattggt<br>atcaacagaagcccggacaggctcctcgccttctgatctacc<br>acaccagccggctccattctggaatccctgccaggttcagc<br>ggtagcggatctgggaccgactacaccctcactatcagctc<br>actgcagccagaggacttcgctgtctatttctgtcagcaagg<br>gaacaccctgccctacacctttggacagggcaccaagctcg<br>agattaaaggtggaggtggcagcggaggaggtgggtccg<br>gcggtggaggaagccaggtccaactccaagaaagcggac<br>cgggtcttgtgaagccatcagaaactctttcactgacttgtact<br>gtgagcggagtgtctctcccgattacggggtgtcttggatc<br>agacagccaccggggaagggtctggaatggattggagtga<br>tttggggctctgagactacttactaccaatcatccctcaagtca<br>cgcgtcaccatctcaaaggacaactctaagaatcaggtgtca<br>ctgaaactgtcatctgtgaccgcagccgacaccgccgtgta<br>ctattgcgctaagcattactattatggcgggagctacgcaatg<br>gattactggggacagggtactctggtcaccgtgtccagcgg<br>aggggggggagtgaagtgcagcttcaacaatcaggacca<br>ggactcgtcaaaccatcacagaccctctccctcacatgtgcc<br>atctccggggactccatgttgagcaattccgacacttggaatt<br>ggattagacaaagcccgtcccggggtctggaatggttggga<br>cgcacctaccaccggtctacttggtacgacgactacgcgtca<br>tccgtgcggggaagagtgtccatcaacgtggacacctcaa<br>gaaccagtacagcctgcagcttaatgccgtgactcctgagg<br>atacgggcgtctactactgcgcccgcgtccgcctgcaagac<br>gggaacagctggagcgatgcattcgatgtctggggccagg<br>gaactatggtcaccgtgtcgtctggcggaggaggctcccag<br>tccgctcttacccaaccggcctcagcctcggggagccccgg<br>ccagagcgtgaccatttcctgcaccggcacttcatccgacgt<br>gggcggctacaactacgtgtcctggtaccaacagcacccg<br>ggaaaggcccccaagctcatgatctacgacgtgtccaacag<br>gccctcgggagtgtccaaccggttctcgggttcgaaatcgg<br>gaaacacagccagcctgaccatcagcgggactgcaggctga<br>agatgaagccgactactactgctcctctacacctcgtcatcc<br>acgctctacgtgttcggcactggaactcagctgactgtgctg<br>accactacccagcaccgaggccaccccaccccggctccta<br>ccatcgcctcccagcctctgtccctgcgtccggaggcatgta<br>gacccgcagctggtggggccgtgcatacccggggtcttga<br>cttcgcctgcgatatctacatttgggcccctctggctggtactt<br>gcggggtcctgctgctttcactcgtgatcactctttactgtaag<br>cgcggtcggaagaagctgctgtacatctttaagcaacccttc<br>atgaggcctgtgcagactactcaagaggaggacggctgttc<br>atgccggttcccagaggaggaggaaggcggctgcgaact<br>gcgcgtgaaattcagccgcagcgcagatgctccagcctacc<br>agcaggggcagaaccagctctacaacgaactcaatcttggt<br>cggagagaggagtacgacgtgctggacaagcggagagga<br>cgggacccagaaatgggcgggaagccgcgcagaaagaat<br>ccccaagagggcctgtacaacgagctccaaaaggataaga<br>tggcagaagcctatagcgagattggtatgaaggggaacg<br>cagaagaggcaaaggccacgacggactgtaccagggact<br>cagcaccgccaccaaggacacctatgacgctcttcacatgc<br>aggccctgccgcctcggtaa |

TABLE 15-continued

Amino acid and nucleic acid sequences of single CARs targeting CD22 and CD19.

| | | |
|---|---|---|
| SEQ ID NO: 851 | Construct 174 (amino acid sequence) | MALPVTALLLPLALLLHAARPEIVMTQ SPATLSLSPGERATLSCRASQDISKYLN WYQQKPGQAPRLLIYHTSRLHSGIPAR FSGSGSGTDYTLTISSLQPEDFAVYFCQ QGNTLPYTFGQGTKLEIKGGGGSGGG GSGGGGSQVQLQESGPGLVKPSETLSL TCTVSGVSLPDYGVSWIRQPPGKGLE WIGVIWGSETTYYQSSLKSRVTISKDN SKNQVSLKLSSVTAADTAVYYCAKHY YYGGSYAMDYWGQGTLVTVSSGGGG SEVQLQQSGPGLVKPSQTLSLTCAISGD SMLSNSDTWNWIRQSPSRGLEWLGRT YHRSTWYDDYASSVRGRVSINVDTSK NQYSLQLNAVTPEDTGVYYCARVRLQ DGNSWSDAFDVWGQGTMVTVSSGGG GSQSALTQPASASGSPGQSVTISCTGTS SDVGGYNYVSWYQQHPGKAPKLMIY DVSNRPSGVSNRFSGSKSGNTASLTISG LQAEDEADYYCSSYTSSSTLYVFGTGT QLTVLTTTPAPRPPTPAPTIASQPLSLRP EACRPAAGGAVHTRGLDFACDIYIWA PLAGTCGVLLLSLVITLYCKRGRKKLL YIFKQPFMRPVQTTQEEDGCSCRFPEEE EGGCELRVKFSRSADAPAYQQGQNQL YNELNLGRREEYDVLDKRRGRDPEMG GKPRRKNPQEGLYNELQKDKMAEAYS EIGMKGERRRGKGHDGLYQGLSTATK DTYDALHMQALPPR |
| SEQ ID NO: 852 | Construct 177 (nucleic acid sequence) | atggccctccctgtcaccgccctgctgcttccgctggctcttc tgctccacgccgctcggcccgaaattgtgatgacccagtca cccgccactcttagcctttcaccggtgagcgcgcaaccctg tcttgcagagcctcccaagacatctcaaaataccttaattggt atcaacagaagcccggacaggctcctcgccttctgatctacc acaccagccggctccattctggaatccctgccaggttcagc ggtagcggatctgggaccgactacaccctcactatcagctc actgcagccagaggacttcgctgtctatttctgtcagcaagg gaacaccctgccctacacctttggacagggcaccaagctcg agattaaaggtggaggtggcagcggaggaggtgggtccg gcggtggaggaagccaggtccaactccaagaaagcggac cgggtcttgtgaagccatcagaaactcttcactgacttgtact gtgagcggagtgtctctccccgattacggggtgtcttggatc agacagccaccggggaagggtctggaatggattggagtga tttggggctctgagactacttactaccaatcatccctcaagtca cgcgtcaccatctcaaaggacaactctaagaatcaggtgtca ctgaaactgtcatctgtgaccgcagccgacaccgccgtgta ctattgcgctaagcattactattatggcgggagctacgcaatg gattactggggacagggtactctggtcaccgtgtccagcttg gcagaagccgccgcgaaacagtccgctcttacccaaccgg cctcagcctcggggagccccggccagagcgtgaccatttc ctgcaccggcacttcatccgacgtgggcggctacaactacg tgtcctggtaccaacagcacccgggaaaggcccccaagct catgatctacgacgtgtccaacaggccctcgggagtgtcca accggttctcgggttcgaaatcgggaaacacagccagcctg accatcagcggactgcaggctgaagatgaagccgactacta ctgctcctcctacacctcgtcatccacgctctacgtgttcggc actggaactcagctgactgtgctgggggcggtggatcgg gtggcggggttcggggggcggcggctctgaagtgcagct tcaacaatcaggaccaggactcgtcaaaccatcacagaccc tctccctcacatgtgccatctccggggactccatgttgagcaa ttccgacacttggaattggattagacaaagcccgtcccgggg tctggaatggttgggacgcacctaccaccggtctacttggta cgacgactacgcgtcatccgtcggggaagagtgtccatca acgtggacacctccaagaaccagtacagcctgcagcttaat gccgtgactcctgaggatacgggcgtctactactgcgcccg cgtccgcctgcaagacgggaacagctggagcgatgcattc gatgtctggggccagggaactatggtcaccgtgtcgtctacc actccccagcaccgaggccacccaccccggctcctacca tcgcctcccagcctctgtccctgcgtccggaggcatgtagac ccgcagctggtggggccgtgcatacccgggtcttgacttc gcctgcgatatctacatttgggcccctctggctggtacttgcg gggtcctgctgctttcactcgtgatcactctttactgtaagcgc ggtcggaagaagctgctgtacatctttaagcaacccttcatga ggcctgtgcagactactcaagaggaggacggctgttcatgc cggttcccagaggaggaaggcggctgcgaactgcgc gtgaaattcagccgcagcgcagatgctccagcctaccagca ggggcagaaccagctctacaacgaactcaatcttggtcgga gagaggagtacgacgtgctggacaagcggagaggacgg |

TABLE 15-continued

Amino acid and nucleic acid sequences of single CARs targeting CD22 and CD19.

|  |  |  |
|---|---|---|
|  |  | gacccagaaatgggcgggaagccgcgcagaaagaatccc caagagggcctgtacaacgagctccaaaaggataagatgg cagaagcctatagcgagattggtatgaaaggggaacgcag aagaggcaaaggccacgacggactgtaccagggactcag caccgccaccaaggacacctatgacgctcttcacatgcagg ccctgccgcctcggtaa |
| SEQ ID NO: 853 | Construct 177 (amino acid sequence) | MALPVTALLLPLALLLHAARPEIVMTQ SPATLSLSPGERATLSCRASQDISKYLN WYQQKPGQAPRLLIYHTSRLHSGIPAR FSGSGSGTDYTLTISSLQPEDFAVYFCQ QGNTLPYTFGQGTKLEIKGGGGSGGG GSGGGGSQVQLQESGPGLVKPSETLSL TCTVSGVSLPDYGVSWIRQPPGKGLE WIGVIWGSETTYYQSSLKSRVTISKDN SKNQVSLKLSSVTAADTAVYYCAKHY YYGGSYAMDYWGQGTLVTVS*SLAEAA AK*FQSALTQPASASGSPGQSVTISCTGTS SDVGGYNYVSWYQQHPGKAPKLMIY DVSNRPSGVSNRFSGSKSGNTASLTISG LQAEDEADYYCSSYTSSSTLYVFGTGT QLTVLGGGGSGGGGSGGGGSEVQLQQ SGPGLVKPSQTLSLTCAISGDSMLSNSD TWNWIRQSPSRGLEWLGRTYHRSTWY DDYASSVRGRVSINVDTSKNQYSLQLN AVTPEDTGVYYCARVRLQDGNSWSD AFDVWGQGTMVTVSSTTTPAPRPPTPA PTIASQPLSLRPEACRPAAGGAVHTRG LDFACDIYIWAPLAGTCGVLLLSLVITL YCKRGRKKLLYIFKQPFMRPVQTTQEE DGCSCRFPEEEEGGCELRVKFSRSADA PAYQQGQNQLYNELNLGRREEYDVLD KRRGRDPEMGGKPRRKNPQEGLYNEL QKDKMAEAYSEIGMKGERRRGKGHD GLYQGLSTATKDTYDALHMQALPPR* |
| SEQ ID NO: 854 | Construct 178 (nucleic acid sequence) | atggcctccctgtcaccgccctgctgcttccgctggctcttc tgctccacgccgctcggcccgaaattgtgatgacccagtca cccgccactcttagcctttcacccggtgagcgcgcaaccctg tcttgcagagcctcccaagacatctcaaaataccttaattggt atcaacagaagcccggacaggctcctcgccttctgatctacc acaccagccggctccattctggaatccctgccaggttcagc ggtagcggatctgggaccgactacaccctcactatcagctc actgcagccagaggacttcgctgtctatttctgtcagcaagg gaacaccctgccctacacctttggacagggcaccaagctcg agattaaaggtggaggtggcagcggaggaggtgggtccg gcggtggaggaagccaggtccaactccaagaaagcggac cgggtcttgtgaagccatcagaaactctttcactgacttgtact gtgagcggagtgtctctccccgattacggggtgtcttggatc agacagccaccggggaagggtctggaatggattggagtga tttggggctctgagactactactaccaatcatccctcaagtca cgcgtcaccatctcaaaggacaactctaagaatcaggtgtca ctgaaactgtcatctgtgaccgcagccgacaccgccgtgta ctattgcgctaagcattactattatggcgggagctacgcaatg gattactggggacagggtactctggtcaccgtgtccagcgg agggggagggagtcagtccgctcttacccaaccggcctca gcctcggggagccccggccagagcgtgaccattcctgca ccggcacttcatccgacgtgggcggctacaactacgtgtcct ggtaccaacagcacccgggaaaggcccccaagctcatgat ctacgacgtgtccaacaggccctcgggagtgtccaaccggt tctcgggttcgaaatcgggaaacacagccagcctgaccatc agcggactgcaggctgaagatgaagccgactactactgctc ctcctacacctcgtcatccacgctctacgtgttcggcactgga actcagctgactgtgctgggggggcggtggatcgggtggcg ggggttcgggggcggcggctctgaagtgcagcttcaaca tcaggaccaggactcgtcaaaccatcacagaccctctccct cacatgtgccatctccggggactccatgttgagcaattccga cacttggaattggattagacaaagcccgtcccggggtctgg aatggttgggacgcacctaccaccggtctacttggtacgacg actacgcgtcatccgtgcgggaagagtgtccatcaacgtg gacacctccaagaaccagtacagcctgcagcttaatgccgt gactcctgaggatacgggcgtctactactgcgcccgcgtcc gcctgcaagacgggaacagctggagcgatgcattcgatgtc tggggccagggaactatggtcaccgtgtcgtctaccactacc ccagcaccgaggccacccacccggctcctaccatcgcct cccagcctctgtccctgcgtccggaggcatgtagaccgca gctggtggggccgtgcatcccggggtcttgacttcgcctg cgatatctacatttgggcccctctggctggtacttgcggggtc |

TABLE 15-continued

Amino acid and nucleic acid sequences of single CARs targeting CD22 and CD19.

|  |  |  |
|---|---|---|
|  |  | ctgctgctttcactcgtgatcactctttactgtaagcgcggtcg<br>gaagaagctgctgtacatctttaagcaaccctcatgaggcct<br>gtgcagactactcaagaggaggacggctgttcatgccggtt<br>cccagaggaggaggaaggcggctgcgaactgcgcgtgaa<br>attcagccgcagcgcagatgctccagcctaccagcagggg<br>cagaaccagctctacaacgaactcaatcttggtcggagaga<br>ggagtacgacgtgctggacaagcggagaggacgggaccc<br>agaaatgggcgggaagccgcgcagaaagaatccccaaga<br>gggcctgtacaacgagctccaaaaggataagatggcagaa<br>gcctatagcgagattggtatgaaaggggaacgcagaagag<br>gcaaaggccacgacggactgtaccagggactcagcaccg<br>ccaccaaggacacctatgacgctcttcacatgcaggccctg<br>ccgcctcggtaa |
| SEQ ID NO: 855 | Construct 178<br>(amino acid<br>sequence) | MALPVTALLLPLALLLHAARPEIVMTQ<br>SPATLSLSPGERATLSCRASQDISKYLN<br>WYQQKPGQAPRLLIYHTSRLHSGIPAR<br>FSGSGSGTDYTLTISSLQPEDFAVYFCQ<br>QGNTLPYTFGQGTKLEIKGGGGSGGG<br>GSGGGGSQVQLQESGPGLVKPSETLSL<br>TCTVSGVSLPDYGVSWIRQPPGKGLE<br>WIGVIWGSETTYYQSSLKSRVTISKDN<br>SKNQVSLKLSSVTAADTAVYYCAKHY<br>YYGGSYAMDYWGQGTLVTVSSGGGG<br>SQSALTQPASASGSPGQSVTISCTGTSS<br>DVGGYNYVSWYQQHPGKAPKLMIYD<br>VSNRPSGVSNRFSGSKSGNTASLTISGL<br>QAEDEADYYCSSYTSSSTLYVFGTGTQ<br>LTVLGGGGSGGGGSGGGGSEVQLQQS<br>GPGLVKPSQTLSLTCAISGDSMLSNSDT<br>WNWIRQSPSRGLEWLGRTYHRSTWYD<br>DYASSVRGRVSINVDTSKNQYSLQLNA<br>VTPEDTGVYYCARVRLQDGNSWSDAF<br>DVWGQGTMVTVSSTTTPAPRPPTPAPT<br>IASQPLSLRPEACRPAAGGAVHTRGLD<br>FACDIYIWAPLAGTCGVLLLSLVITLYC<br>KRGRKKLLYIFKQPFMRPVQTTQEEDG<br>CSCRFPEEEEGGCELRVKFSRSADAPA<br>YQQGQNQLYNELNLGRREEYDVLDKR<br>RGRDPEMGGKPRRKNPQEGLYNELQK<br>DKMAEAYSEIGMKGERRRGKGHDGL<br>YQGLSTATKDTYDALHMQALPPR |
| SEQ ID NO: 856 | Construct 179<br>(nucleic acid<br>sequence) | atggccctccctgtcaccgccctgctgcttccgctggctcttc<br>tgctccacgccgctcggcccgaaattgtgatgacccagtca<br>cccgccactcttagcctttcaccggtgagcgcgcaaccctg<br>tcttgcagagcctcccaagacatctcaaaataccttaattggt<br>atcaacagaagcccggacaggctcctcgcctttctgatctacc<br>acaccagccggctccattctggaatccctgccaggttcagc<br>ggtagcggatctgggaccgactacaccctcactatcagctc<br>actgcagccagaggacttcgctgtctatttctgtcagcaagg<br>gaacaccctgccctacacctttggacagggcaccaagctcg<br>agattaaaggtggaggtggcagcggaggaggtgggtccg<br>gcggtggaggaagccaggtccaactccaagaaagcggac<br>cgggtcttgtgaagccatcagaaactctttcactgacttgtact<br>gtgagcggagtgtctctcccgattacggggtgtcttggatc<br>agacagccaccggggaagggtctggaatggattggagtga<br>tttggggctctgagactacttactaccaatcatccctcaagtca<br>cgcgtcaccatctcaaaggacaactctaagaatcaggtgtca<br>ctgaaactgtcatctgtgaccgcagccgacaccgccgtgta<br>ctattgcgctaagcattactattatggcgggagctacgcaatg<br>gattactggggacagggtactctggtcaccgtgtccagcttg<br>gcagaagccgccgcgaaacagtccgctcttacccaaccgg<br>cctcagcctcggggagccccggccagagcgtgaccatttc<br>ctgcaccggcacttcatccgacgtgggcggctacaactacg<br>tgtcctggtaccaacagcacccgggaaaggcccccaagct<br>catgatctacgacgtgtccaacaggccctcgggagtgtcca<br>accggttctcgggttcgaaatcgggaaacacagccagcctg<br>accatcagcggactgcaggctgaagatgaagccgactacta<br>ctgctcctctacacctcgtcatccacgctctacgtgttcggc<br>actggaactcagctgactgtgctgggcggaggaggctccg<br>aagtgcagcttcaacaatcaggaccaggactcgtcaaacca<br>tcacagaccctctccctcacatgtgccatctccggggactcc<br>atgttgagcaattccgacactttggaattggattagacaaagcc<br>cgtcccggggtctggaatggttgggacgcacctaccaccg<br>gtctacttggtacgacgactacgcgtcatccgtgcgggaa<br>gagtgtccatcaacgtggacacctccaagaaccagtacagc<br>ctgcagcttaatgccgtgactcctgaggatacgggcgtctac TABLE 15-continued Amino acid and nucleic acid sequences of single CARs targeting CD22 and CD19.

| | |
|---|---|
| | tactgcgcccgcgtccgcctgcaagacgggaacagctgga
gcgatgcattcgatgtctggggccagggaactatggtcacc
gtgtcgtctaccactaccccagcaccgaggccacccacccc
ggctcctaccatcgcctcccagcctctgtccctgcgtccgga
ggcatgtagacccgcagctggtggggccgtgcatacccgg
ggtcttgacttcgcctgcgatatctacatttgggcccctctggc
tggtacttgcggggtcctgctgctttcactcgtgatcactcttta
ctgtaagcgcggtcggaagaagctgctgtacatctttaagca
acccttcatgaggcctgtgcagactactcaagaggaggacg
gctgttcatgccggttcccagaggaggaggaaggcggctg
cgaactgcgcgtgaaattcagccgcagcgcagatgctcca
gcctaccagcaggggcagaaccagctctacaacgaactca
atcttggtcggagagaggagtacgacgtgctggacaagcg
gagaggacgggacccagaaatgggcgggaagccgcgca
gaaagaatccccaagagggcctgtacaacgagctccaaaa
ggataagatggcagaagcctatagcgagattggtatgaaag
gggaacgcagaagaggcaaaggccacgacggactgtacc
agggactcagcaccgccaccaaggacacctatgacgctctt
cacatgcaggccctgccgcctcggtaa |
| SEQ ID NO: 857 Construct 179 (amino acid sequence) | MALPVTALLLPLALLLHAARPEIVMTQ
SPATLSLSPGERATLSCRASQDISKYLN
WYQQKPGQAPRLLIYHTSRLHSGIPAR
FSGSGSGTDYTLTISSLQPEDFAVYFCQ
QGNTLPYTFGQGTKLEIKGGGGSGGG
GSGGGGSQVQLQESGPGLVKPSETLSL
TCTVSGVSLPDYGVSWIRQPPGKGLE
WIGVIWGSETTYYQSSLKSRVTISKDN
SKNQVSLKLSSVTAADTAVYYCAKHY
YYGGSYAMDYWGQGTLVTVSS*LAEAA
AK*QSALTQPASASGSPGQSVTISCTGTS
SDVGYNYVSWYQQHPGKAPKLMIY
DVSNRPSGVSNRFSGSKSGNTASLTISG
LQAEDEADYYCSSYTSSSTLYVFGTGT
QLTVLGGGGSEVQLQQSGPGLVKPSQ
TLSLTCAISGDSMLSNSDTWNWIRQSP
SRGLEWLGRTYHRSTWYDDYASSVRG
RVSINVDTSKNQYSLQLNAVTPEDTGV
YYCARVRLQDGNSWSDAFDVWGQGT
MVTVSSTTTPAPRPPTPAPTIASQPLSL
RPEACRPAAGGAVHTRGLDFACDIYIW
APLAGTCGVLLLSLVITLYCKRGRKKL
LYIFKQPFMRPVQTTQEEDGCSCRFPEE
EEGGCELRVKFSRSADAPAYQQGQNQ
LYNELNLGRREEYDVLDKRRGRDPEM
GGKPRRKNPQEGLYNELQKDKMAEA
YSEIGMKGERRRGKGHDGLYQGLSTA
TKDTYDALHMQALPPR |
| SEQ ID NO: 895 Construct 180 (nucleic acid sequence) | atggccctccctgtcaccgccctgctgcttccgctggctcttc
tgctccacgccgctcggcccgaaattgtgatgacccagtca
cccgccactcttagccttttcaccggtgagcgcgcaacccctg
tcttgcagagcctcccaagacatctcaaaatacctttaattggt
atcaacagaaagcccggacaggctcctcgccttctgatctacc
acaccagccggctccattctggaatccctgccaggttcagc
ggtagcggatctgggaccgactacaccctcactatcagctc
actgcagccagaggacttcgctgtctatttctgtcagcaagg
gaacacccttgccctacacctttggacagggcaccaagctcg
agattaaaggtggaggtggcagcggaggaggtgggtccg
gcggtggaggaagccaggtccaactccaagaaagcggac
cgggtcttgtgaagccatcagaaactctttcactgacttgtact
gtgagcggagtgtctctccccgattacggggtgtcttggatc
agacagccaccggggaagggtctggaatggattggagtga
tttggggctctgagactactactaccaatcatccctcaagtca
cgcgtcaccatctcaaaggacaactctaagaatcaggtgtca
ctgaaactgtcatctgtgaccgcagccgacaccgccgtgta
ctattgcgctaagcattactattatggcgggagctacgcaatg
gattactggggacagggtactctggtcaccgtgtccagcgg
aggggagggagtcagtccgctcttacccaaccggcctca
gcctcggggagcccggccagagcgtgaccatttcctgca
ccggcacttcatcgacgtgggcggctacaactacgtgtcct
ggtaccaacagcacccgggaaaggcccccaagctcatgat
ctacgacgtgtccaacaggccctcgggagtgtccaaccggt
tctcgggttcgaaatcgggaaacacagccagcctgaccatc
agcggactgcaggctgaagatgaagccgactactactgctc
ctcctacacctcgtcatccacgctctacgtgttcggcactgga
actcagctgactgtgctgggcggaggaggctccgaagtgc
agcttcaacaatcaggaccaggactcgtcaaaccatcacag |

TABLE 15-continued

Amino acid and nucleic acid sequences of single CARs targeting CD22 and CD19.

| | | |
|---|---|---|
| | | accctctccctcacatgtgccatctccggggactccatgttga
gcaattccgacacttggaattggattagacaaagcccgtccc
ggggtctggaatggttgggacgcacctaccaccggtctactt
ggtacgacgactacgcgtcatccgtgcggggaagagtgtc
catcaacgtggacacctccaagaaccagtacagcctgcagc
ttaatgccgtgactcctgaggatacgggcgtctactactgcg
cccgcgtccgcctgcaagacgggaacagctggagcgatg
cattcgatgtctggggccagggaactatggtcaccgtgtcgt
ctaccactacccagcaccgaggccacccaccccggctcc
taccatcgcctcccagcctctgtccctgcgtccggaggcatg
tagacccgcagctggtggggccgtgcataccgggtgtcttg
acttcgcctgcgatatctacatttgggcccctctggctggtact
tgcggggtcctgctgctttcactcgtgatcactctttactgtaa
gcgcggtcggaagaagctgctgtacatctttaagcaaccctt
catgaggcctgtgcagactactcaagaggaggacggctgtt
catgccggttcccagaggaggaggaaggcggctgcgaact
gcgcgtgaaattcagccgcagcgcagatgctccagcctacc
agcaggggcagaaccagctctacaacgaactcaatcttggt
cggagagaggagtacgacgtgctggacaagcggagagga
cgggacccagaaatgggcgggaagccgcgcagaaagaat
ccccaagagggcctgtacaacgagctccaaaaggataaga
tggcagaagcctatagcgagattggtatgaaagggaacg
cagaagaggcaaaggccacgacggactgtaccagggact
cagcaccgccaccaaggacacctatgacgctcttcacatgc
aggccctgccgcctcggtaa |
| SEQ ID NO: 858 | Construct 180
(amino acid
sequence) | MALPVTALLLPLALLLHAARPEIVMTQ
SPATLSLSPGERATLSCRASQDISKYLN
WYQQKPGQAPRLLIYHTSRLHSGIPAR
FSGSGSGTDYTLTISSLQPEDFAVYFCQ
QGNTLPYTFGQGTKLEIKGGGGSGGG
GSGGGGSQVQLQESGPGLVKPSETLSL
TCTVSGVSLPDYGVSWIRQPPGKGLE
WIGVIWGSETTYYQSSLKSRVTISKDN
SKNQVSLKLSSVTAADTAVYYCAKHY
YYGGSYAMDYWGQGTLVTVSSGGGG
SQSALTQPASASGSPGQSVTISCTGTSS
DVGGYNYVSWYQQHPGKAPKLMIYD
VSNRPSGVSNRFSGSKSGNTASLTISGL
QAEDEADYYCSSYTSSSTLYVFGTGTQ
LTVLGGGGSEVQLQQSGPGLVKPSQTL
SLTCAISGDSMLSNSDTWNWIRQSPSR
GLEWLGRTYHRSTWYDDYASSVRGR
VSINVDTSKNQYSLQLNAVTPEDTGVY
YCARVRLQDGNSWSDAFDVWGQGTM
VTVSSTTTPAPRPPTPAPTIASQPLSLRP
EACRPAAGGAVHTRGLDFACDIYIWA
PLAGTCGVLLLSLVITLYCKRGRKKLL
YIFKQPFMRPVQTTQEEDGCSCRFPEEE
EGGCELRVKFSRSADAPAYQQGQNQL
YNELNLGRREEYDVLDKRRGRDPEMG
GKPRRKNPQEGLYNELQKDKMAEAYS
EIGMKGERRRGKGHDGLYQGLSTATK
DTYDALHMQALPPR* |
| SEQ ID NO: 859 | Construct 181
(nucleic acid
sequence) | atggccctccctgtcaccgccctgctgcttccgctggctcttc
tgctccacgccgctcggcccgaagtgcagcttcaacaatca
ggaccaggactcgtcaaaccatcacagaccctctccctcac
atgtgccatctccggggactccatgttgagcaattccgacact
tggaattggattagacaaagcccgtcccggggtctggaatg
gttgggacgcacctaccaccggtctacttggtacgacgacta
cgcgtcatccgtgcggggaagagtgtccatcaacgtggaca
cctccaagaaccagtacagcctgcagcttaatgccgtgactc
ctgaggatacgggcgtctactactgcgcccgcgtccgcctg
caagacgggaacagctggagcgatgcattcgatgtctggg
gccagggaactatggtcaccgtgtcgtctggggcggtgg
atcgggtggcggggttcggggggcggcggctctcagtcc
gctcttacccaaccggcctcagcctcggggagcccggcc
agagcgtgaccattcctgcaccggcacttcatccgacgtgg
gcggctacaactacgtgtcctggtaccaacagcacccggga
aaggcccccaagctcatgatctacgacgtgtccaacaggcc
ctcgggagtgtccaaccggttctcgggttcgaaatcgggaa
acacagccagcctgaccatcagcggactgcaggctgaaga
tgaagccgactactactgctcctcctacacctcgtcatccacg
ctctacgtgttcggcactggaactcagctgactgtgctgttgg
cagaagccgccgcgaaagaaattgtgatgacccagtcacc
cgccactcttagccttcacccggtgagcgcgcaaccctgtc
ttgcagagcctcccaagacatctcaaaataccttaattggtat |

TABLE 15-continued

Amino acid and nucleic acid sequences of single CARs targeting CD22 and CD19.

|  |  |
|---|---|
|  | caacagaagcccggacaggctcctcgccttctgatctacca<br>caccagccggctccattctggaatccctgccaggttcagcg<br>gtagcggatctgggaccgactacaccctcactatcagctcac<br>tgcagccagaggacttcgctgtctatttctgtcagcaaggga<br>acaccctgccctacacctttggacagggcaccaagctcgag<br>attaaaggtggaggtggcagcggaggaggtgggtccggc<br>ggtggaggaagccaggtccaactccaagaaagcggaccg<br>ggtcttgtgaagccatcagaaactctttcactgacttgtactgt<br>gagcggagtgtctctccccgattacggggtgtcttggatcag<br>acagccaccggggaagggtctggaatggattggagtgattt<br>ggggctctgagactacttactaccaatcatccctcaagtcac<br>gcgtcaccatctcaaaggacaactctaagaatcaggtgtcac<br>tgaaactgtcatctgtgaccgcagccgacaccgccgtgtact<br>attgcgctaagcattactattatggcgggagctacgcaatgg<br>attactggggacagggtactctggtcaccgtgtccagcacca<br>ctaccccagcaccgaggccacccaccccggctcctaccat<br>cgcctcccagcctctgtccctgcgtccggaggcatgtagac<br>ccgcagctggtggggccgtgcatacccggggtcttgacttc<br>gcctgcgatatctacatttgggccctctggctggtacttgcg<br>gggtcctgctgctttcactcgtgatcactcttttactgtaagcgc<br>ggtcggaagaagctgctgtacatctttaagcaaccccttcatga<br>ggcctgtgcagactactcaagaggaggacggctgttcatgc<br>cggttcccagaggaggaggaaggcggctgcgaactgcgc<br>gtgaaattcagccgcagcgcagatgctccagcctaccagca<br>ggggcagaaccagctctacaacgaactcaatcttggtcgga<br>gagaggagtacgacgtgctggacaagcggagaggacgg<br>gacccagaaatgggcgggaagcccgcgcagaaagaatccc<br>caagagggcctgtacaacgagctccaaaaggataagatgg<br>cagaagcctatagcgagattggtatgaaaggggaacgcag<br>aagaggcaaaggccacgacggactgtaccagggactcag<br>caccgccaccaaggacacctatgacgctcttcacatgcagg<br>ccctgccgcctcggtaa |
| SEQ ID NO: 860 Construct 181<br>(amino acid<br>sequence) | MALPVTALLLPLALLLHAARPEVQLQ<br>QSGPGLVKPSQTLSLTCAISGDSMLSNS<br>DTWNWIRQSPSRGLEWLGRTYHRSTW<br>YDDYASSVRGRVSINVDTSKNQYSLQL<br>NAVTPEDTGVYYCARVRLQDGNSWS<br>DAFDVWGQGTMVTVSSGGGGSGGGG<br>SGGGGSQSALTQPASASGSPGQSVTISC<br>TGTSSDVGGYNYVSWYQQHPGKAPKL<br>MIYDVSNRPSGVSNRFSGSKSGNTASL<br>TISGLQAEDEADYYCSSYTSSSTLYVFG<br>TGTQLTVL*LAEAAAK*EIVMTQSPATLSL<br>SPGERATLSCRASQDISKYLNWYQQKP<br>GQAPRLLIYHTSRLHSGIPARFSGSGSG<br>TDYTLTISSLQPEDFAVYFCQQGNTLP<br>YTFGQGTKLEIKGGGGSGGGGSGGGG<br>SQVQLQESGPGLVKPSETLSLTCTVSG<br>VSLPDYGVSWIRQPPGKGLEWIGVIWG<br>SETTYYQSSLKSRVTISKDNSKNQVSL<br>KLSSVTAADTAVYYCAKHYYYGGSY<br>AMDYWGQGTLVTVSSTTTPAPRPPTP<br>APTIASQPLSLRPEACRPAAGGAVHTR<br>GLDFACDIYIWAPLAGTCGVLLLSLVIT<br>LYCKRGRKKLLYIFKQPFMRPVQTTQE<br>EDGCSCRFPEEEEGGCELRVKFSRSAD<br>APAYQQGQNQLYNELNLGRREEYDVL<br>DKRRGRDPEMGGKPRRKNPQEGLYNE<br>LQKDKMAEAYSEIGMKGERRRGKGH<br>DGLYQGLSTATKDTYDALHMQALPPR |
| SEQ ID NO: 861 Construct 182<br>(nucleic acid<br>sequence) | atggccctccctgtcaccgccctgctgcttccgctggctcttc<br>tgctccacgccgctcggcccgaagtgcagcttcaacaatca<br>ggaccaggactcgtcaaaccatcacagaccctctccctcac<br>atgtgccatctccggggactccatgttgagcaattccgacact<br>tggaattggattagacaaagcccgtcccggggtctggaatg<br>gttgggacgcacctaccaccggtctacttggtacgacgacta<br>cgcgtcatccgtgcggggaagagtgtccatcaacgtggaca<br>cctccaagaaccagtacagcctgcagcttaatgccgtgactc<br>ctgaggatacgggcgtctactactgcgcccgcgtccgcctg<br>caagacgggaacagctggagcgatgcattcgatgtctggg<br>gccagggaactatggtcaccgtgtcgtctggggcggtgg<br>atcgggtggcggggttcggggggcggcggctctcagtcc<br>gctcttacccaaccggcctcagcctcggggagccccggcc<br>agagcgtgaccatttcctgcaccggcacttcatccgacgtgg<br>gcggctacaactacgtgtcctggtaccaacagcacccggga<br>aaggccccaagctcatgatctacgacgtgtccaacaggcc |

TABLE 15-continued

Amino acid and nucleic acid sequences of single CARs targeting CD22 and CD19.

| | |
|---|---|
| | ctcgggagtgtccaaccggttctcgggttcgaaatcgggaa<br>acacagccagcctgaccatcagcggactgcaggctgaaga<br>tgaagccgactactactgctcctctacacctcgtcatccacg<br>ctctacgtgttcggcactggaactcagctgactgtgctggga<br>gggggagggagtgaaattgtgatgacccagtcacccgcca<br>ctcttagcctttcacccggtgagcgcgcaaccctgtcttgcag<br>agcctcccaagacatctcaaaataccttaattggtatcaacag<br>aagcccggacaggctcctcgccttctgatctaccacaccag<br>ccggctccattctggaatccctgccaggttcagcggtagcg<br>gatctgggaccgactacaccctcactatcagctcactgcagc<br>cagaggacttcgctgtctatttctgtcagcaagggaacaccct<br>gccctacacctttggacagggcaccaagctcgagattaaag<br>gtggaggtggcagcggaggaggtgggtccggcggtggag<br>gaagccaggtccaactccaagaaagcggaccgggtcttgt<br>gaagccatcagaaactctttcactgacttgtactgtgagcgga<br>gtgtctctccccgattacggggtgtcttggatcagacagcca<br>ccgggggaagggtctggaatggattggagtgatttggggctc<br>tgagactacttactaccaatcatccctcaagtcacgcgtcacc<br>atctcaaaggacaactctaagaatcaggtgtcactgaaactg<br>tcatctgtgaccgcagccgacaccgccgtgtactattgcgct<br>aagcattactattatggcgggagctacgcaatggattactgg<br>ggacagggtactctggtcaccgtgtccagcaccactacccc<br>agcaccgaggccacccaccccggctcctaccatcgcctcc<br>cagcctctgtccctgcgtccggaggcatgtagacccgcagc<br>tggtggggccgtgcatacccggggtcttgacttcgcctgcg<br>atatctacatttgggcccctctggctggtacttgcggggtcct<br>gctgctttcactcgtgatcactctttactgtaagcgcggtcgga<br>agaagctgctgtacatctttaagcaacccttcatgaggcctgt<br>gcagactactcaagaggaggacggctgttcatgccggttcc<br>cagaggaggaggaaggcggctgcgaactgcgcgtgaaat<br>tcagccgcagcgcagatgctccagcctaccagcaggggca<br>gaaccagctctacaacgaactcaatcttggtcggagagagg<br>agtacgacgtgctggacaagcggagaggacgggacccag<br>aaatgggcgggaagccgcgcagaaagaatccccaagagg<br>gcctgtacaacgagctccaaaaggataagatggcagaagc<br>ctatagcgagattggtatgaaaggggaacgcagaagaggc<br>aaaggccacgacggactgtaccagggactcagcaccgcc<br>accaaggacacctatgacgctcttcacatgcaggccctgcc<br>gcctcggtaa |
| SEQ ID NO: 862 Construct 182<br>(amino acid<br>sequence) | MALPVTALLLPLALLLHAARPEVQLQ<br>QSGPGLVKPSQTLSLTCAISGDSMLSNS<br>DTWNWIRQSPSRGLEWLGRTYHRSTW<br>YDDYASSVRGRVSINVDTSKNQYSLQL<br>NAVTPEDTGVYYCARVRLQDGNSWS<br>DAFDVWGQGTMVTVSSGGGGSGGGG<br>SGGGGSQSALTQPASASGSPGQSVTISC<br>TGTSSDVGGYNYVSWYQQHPGKAPKL<br>MIYDVSNRPSGVSNRFSGSKSGNTASL<br>TISGLQAEDEADYYCSSYTSSSTLYVFG<br>TGTQLTVLGGGGSEIVMTQSPATLSLS<br>PGERATLSCRASQDISKYLNWYQQKP<br>GQAPRLLIYHTSRLHSGIPARFSGSGSG<br>TDYTLTISSLQPEDFAVYFCQQGNTLP<br>YTFGQGTKLEIKGGGGSGGGGSGGGG<br>SQVQLQESGPGLVKPSETLSLTCTVSG<br>VSLPDYGVSWIRQPPGKGLEWIGVIWG<br>SETTYYQSSLKSRVTISKDNSKNQVSL<br>KLSSVTAADTAVYYCAKHYYYGGSY<br>AMDYWGQGTLVTVSSTTTPAPRPPTP<br>APTIASQPLSLRPEACRPAAGGAVHTR<br>GLDFACDIYIWAPLAGTCGVLLLSLVIT<br>LYCKRGRKKLLYIFKQPFMRPVQTTQE<br>EDGCSCRFPEEEEGGCELRVKFSRSAD<br>APAYQQGQNQLYNELNLGRREEYDVL<br>DKRRGRDPEMGGKPRRKNPQEGLYNE<br>LQKDKMAEAYSEIGMKGERRRGKGH<br>DGLYQGLSTATKDTYDALHMQALPPR |
| SEQ ID NO: 863 Construct 183<br>(nucleic acid<br>sequence) | atggcctccctgtcaccgcctgctgcttccgctggctcttc<br>tgctccacgccgctcggcccgaagtgcagcttcaacaatca<br>ggaccaggactcgtcaaaccatcacagaccctctccctcac<br>atgtgccatctccggggactccatgttgagcaattccgacact<br>tggaattggattagacaaagcccgtcccggggtctggaatg<br>gttgggacgcacctaccaccggtctacttggtacgacgacta<br>cgcgtcatccgtgcggggaagagtgtccatcaacgtggaca<br>cctccaagaaccagtacagcctgcagcttaatgccgtgactc<br>ctgaggatacgggcgtctactactgcgcccgcgtccgcctg |

TABLE 15-continued

Amino acid and nucleic acid sequences of single CARs targeting CD22 and CD19.

|  |  |
|---|---|
|  | caagacgggaacagctggagcgatgcattcgatgtctggg<br>gccagggaactatggtcaccgtgtcgtctggcggaggagg<br>ctcccagtccgctcttacccaaccggcctcagcctcgggga<br>gccccggccagagcgtgaccatttcctgcaccggcacttca<br>tccgacgtgggcggctacaactacgtgtcctggtaccaaca<br>gcacccgggaaaggcccccaagctcatgatctacgacgtgt<br>ccaacaggccctcgggagtgtccaaccggttctcgggttcg<br>aaatcggaaacacagccagcctgaccatcagcggactgc<br>aggctgaagatgaagccgactactactgctcctcctacacct<br>cgtcatccacgctctacgtgttcggcactggaactcagctga<br>ctgtgctgttggcagaagccgccgcgaaagaaattgtgatg<br>acccagtcacccgccactcttagcctttcacccggtgagcgc<br>gcaaccctgtcttgcagagcctcccaagacatctcaaaatac<br>cttaattggtatcaacagaagcccggacaggctcctcgcctt<br>ctgatctaccacaccagccggctccattctggaatccctgcc<br>aggttcagcggtagcggatctgggaccgactacaccctcac<br>tatcagctcactgcagccagaggacttcgctgtctatttctgtc<br>agcaagggaacaccctgccctacacctttggacagggcac<br>caagctcgagattaaaggtggaggtggcagcggaggaggt<br>gggtccggcggtggaggaagccaggtccaactccaagaa<br>agcggaccgggtcttgtgaagccatcagaaactctttcactg<br>acttgtactgtgagcggagtgtctctccccgattacgggtgt<br>cttggatcagacagccaccggggaagggtctggaatgatt<br>ggagtgatttggggctctgagactacttactaccaatcatccc<br>tcaagtcacgcgtcaccatctcaaaggacaactctaagaatc<br>aggtgtcactgaaactgtcatctgtgaccgcagccgacacc<br>gccgtgtactattgcgctaagcattactattatggcgggagct<br>acgcaatggattactggggacagggtactctggtcaccgtgt<br>ccagcaccactaccccagcaccgaggccacccaccccgg<br>ctcctaccatcgcctcccagcctctgtccctgcgtccggagg<br>catgtagacccgcagctggtggggccgtgcatacccgggg<br>tcttgacttcgcctgcgatatctacatttgggccctctggctg<br>gtacttgcggggtcctgctgcttcactcgtgatcactctttact<br>gtaagcgcggtcggaagaagctgctgtacatctttaagcaac<br>ccttcatgaggcctgtgcagactactcaagaggaggacggc<br>tgttcatgccggttcccagaggaggaggaaggcggctgcg<br>aactcgcgtgaaattcagccgcagcgcagatgctccagcc<br>taccagcaggggcagaaccagctctacaacgaactcaatct<br>tggtcggagagaggagtacgacgtgctggacaagcggag<br>aggacgggacccagaaatgggcgggaagccgcgcagaa<br>agaatccccaagagggcctgtacaacgagctccaaaagga<br>taagatggcagaagcctatagcgagattggtatgaaagggg<br>aacgcagaagaggcaaaggccacgacggactgtaccagg<br>gactcagcaccgccaccaaggacacctatgacgctcttcac<br>atgcaggccctgccgcctcggtaa |
| SEQ ID NO: 864 Construct 183<br>(amino acid<br>sequence) | MALPVTALLLPLALLLHAARPEVQLQ<br>QSGPGLVKPSQTLSLTCAISGDSMLSNS<br>DTWNWIRQSPSRGLEWLGRTYHRSTW<br>YDDYASSVRGRVSINVDTSKNQYSLQL<br>NAVTPEDTGVYYCARVRLQDGNSWS<br>DAFDVWGQGTMVTVSSGGGGSQSAL<br>TQPASASGSPGQSVTISCTGTSSDVGGY<br>NYVSWYQQHPGKAPKLMIYDVSNRPS<br>GVSNRFSGSKSGNTASLTISGLQAEDE<br>ADYYCSSYTSSSTLYVFGTGTQLTVL<u>LA<br>EAAAK</u>EIVMTQSPATLSLSPGERATLSCR<br>ASQDISKYLNWYQQKPGQAPRLLIYHT<br>SRLHSGIPARFSGSGSGTDYTLTISSLQP<br>EDFAVYFCQQGNTLPYTFGQGTKLEIK<br>GGGGSGGGGSGGGGSQVQLQESGPGL<br>VKPSETLSLTCTVSGVSLPDYGVSWIR<br>QPPGKGLEWIGVIWGSETTYYQSSLKS<br>RVTISKDNSKNQVSLKLSSVTAADTAV<br>YYCAKHYYYGGSYAMDYWGQGTLV<br>TVSSTTTPAPRPPTPAPTIASQPLSLRPE<br>ACRPAAGGAVHTRGLDFACDIYIWAP<br>LAGTCGVLLLSLVITLYCKRGRKKLLY<br>IFKQPFMRPVQTTQEEDGCSCRFPEEEE<br>GGCELRVKFSRSADAPAYQQGQNQLY<br>NELNLGRREEYDVLDKRRGRDPEMGG<br>KPRRKNPQEGLYNELQKDKMAEAYSE<br>IGMKGERRRGKGHDGLYQGLSTATKD<br>TYDALHMQALPPR |
| SEQ ID NO: 865 Construct 184<br>(nucleic acid<br>sequence) | atggcccctcctgtcaccgccctgctgcttccgctggctcttc<br>tgctccacgccgctcggcccgaagtgcagcttcaacaatca<br>ggaccaggactcgtcaaaccatcacagaccctctccctcac |

TABLE 15-continued

Amino acid and nucleic acid sequences of single CARs targeting CD22 and CD19.

| | |
|---|---|
| | atgtgccatctccggggactccatgttgagcaattccgacact<br>tggaattggattagacaaagcccgtcccggggtctggaatg<br>gttgggacgcacctaccaccggtctacttggtacgacgacta<br>cgcgtcatccgtgcggggaagagtgtccatcaacgtggaca<br>cctccaagaaccagtacagcctgcagcttaatgccgtgactc<br>ctgaggatacgggcgtctactactgcgcccgcgtccgcctg<br>caagacgggaacagctggagcgatgcattcgatgtctggg<br>gccagggaactatggtcaccgtgtcgtctggcggaggagg<br>ctcccagtccgctcttacccaaccggcctcagcctcgggga<br>gccccggccagagcgtgaccatttcctgcaccggcacttca<br>tccgacgtgggcggctacaactacgtgtcctggtaccaaca<br>gcacccgggaaaggcccccaagctcatgatctacgacgtgt<br>ccaacaggccctcgggagtgtccaaccggttctcgggttcg<br>aaatcgggaaacacagccagcctgaccatcagcggactgc<br>aggctgaagatgaagccgactactgctcctcctacacct<br>cgtcatccacgctctacgtgttcggcactggaactcagctga<br>ctgtgctgggagggagggagtgaaattgtgatgaccca<br>gtcacccgccactcttagcctttcacccggtgagcgcgaac<br>cctgtcttgcagagcctcccaagacatctcaaaataccttaatt<br>ggtatcaacagaagcccggacaggctcctcgccttctgatct<br>accacaccagccggctccattctggaatccctgccaggttca<br>gcggtagcggatctgggaccgactacaccctcactatcagc<br>tcactgcagccagaggacttcgctgtctatttctgtcagcaag<br>ggaacaccctgccctacacctttggacagggcaccaagctc<br>gagattaaaggtggaggtggcagcggaggaggtgggtcc<br>ggcggtggaggaagccaggtccaactccaagaaagcgga<br>ccgggtcttgtgaagccatcagaaactctttcactgacttgta<br>ctgtgagcggagtgtctctccccgattacggggtgtcttggat<br>cagacagccaccggggaagggtctggaatggattggagtg<br>atttggggctctgagactacttactaccaatcatccctcaagtc<br>acgcgtcaccatctcaaaggacaactctaagaatcaggtgtc<br>actgaaactgtcatctgtgaccgcagccgacaccgccgtgt<br>actattgcgctaagcattactattatggcgggagctacgcaat<br>ggattactggggacagggtactctggtcaccgtgtccagca<br>ccactccccagcaccgaggccacccacccggctcctac<br>catcgcctcccagcctctgtccctgcgtccggaggcatgtag<br>acccgcagctggtggggccgtgcatacccggggtcttgact<br>tcgcctgcgatatctacatttgggcccctctggctggtacttgc<br>ggggtcctgctgctttcactcgtgatcactctttactgtaagcg<br>cggtcggaagaagctgctgtacatctttaagcaaccccttcatg<br>aggcctgtgcagactactcaagaggaggacggctgttcatg<br>ccggttcccagaggaggaggaaggcggctgcgaactgcg<br>cgtgaaattcagccgcagcgcagatgctccagcctaccagc<br>aggggcagaaccagctctacaacgaactcaatcttggtcgg<br>agagaggagtacgacgtgctggacaagcggagaggacgg<br>gacccagaaatgggcgggaagccgcgcagaaagaatccc<br>caagagggcctgtacaacgagctccaaaaggataagatgg<br>cagaagcctatagcgagattggtatgaaaggggaacgcag<br>aagaggcaaaggccacgacggactgtaccagggactcag<br>caccgccaccaaggacacctatgacgctcttcacatgcagg<br>ccctgccgcctcggtaa |
| SEQ ID NO: 866 Construct 184<br>(amino acid<br>sequence) | MALPVTALLLPLALLLHAARPEVQLQ<br>QSGPGLVKPSQTLSLTCAISGDSMLSNS<br>DTWNWIRQSPSRGLEWLGRTYHRSTW<br>YDDYASSVRGRVSINVDTSKNQYSLQL<br>NAVTPEDTGVYYCARVRLQDGNSWS<br>DAFDVWGQGTMVTVSSGGGGSQSAL<br>TQPASASGSPGQSVTISCTGTSSDVGGY<br>NYVSWYQQHPGKAPKLMIYDVSNRPS<br>GVSNRFSGSKSGNTASLTISGLQAEDE<br>ADYYCSSYTSSSTLYVFGTGTQLTVLG<br>GGGSEIVMTQSPATLSLSPGERATLSCR<br>ASQDISKYLNWYQQKPGQAPRLLIYHT<br>SRLHSGIPARFSGSGSGTDYTLTISSLQP<br>EDFAVYFCQQGNTLPYTFGQGTKLEIK<br>GGGGSGGGGSGGGGSQVQLQESGPGL<br>VKPSETLSLTCTVSGVSLPDYGVSWIR<br>QPPGKGLEWIGVIWGSETTYYQSSLKS<br>RVTISKDNSKNQVSLKLSSVTAADTAV<br>YYCAKHYYYGGSYAMDYWGQGTLV<br>TVSSTTTPAPRPPTPAPTIASQPLSLRPE<br>ACRPAAGGAVHTRGLDFACDIYIWAP<br>LAGTCGVLLLSLVITLYCKRGRKKLLY<br>IFKQPFMRPVQTTQEEDGCSCRFPEEEE<br>GGCELRVKFSRSADAPAYQQGQNQLY<br>NELNLGRREEYDVLDKRRGRDPEMGG<br>KPRRKNPQEGLYNELQKDKMAEAYSE |

TABLE 15-continued

Amino acid and nucleic acid sequences of single CARs targeting CD22 and CD19.

| | | |
|---|---|---|
| | | IGMKGERRRGKGHDGLYQGLSTATKD<br>TYDALHMQALPPR |
| SEQ ID NO: 867 | Construct 185<br>(nucleic acid<br>sequence) | atggccctccctgtcaccgccctgctgcttccgctggctcttc<br>tgctccacgccgctcggcccagtccgctcttacccaaccg<br>gcctcagcctcggggagccccggccagagcgtgaccattt<br>cctgcaccggcacttcatccgacgtgggcggctacaactac<br>gtgtcctggtaccaacagcacccgggaaaggcccccaagc<br>tcatgatctacgacgtgtccaacaggccctcgggagtgtcca<br>accggttctcgggttcgaaatcgggaaacacagccagcctg<br>accatcagcggactgcaggctgaagatgaagccgactacta<br>ctgctcctccatacacctcgtcatccacgctctacgtgttcggc<br>actggaactcagctgactgtgctgggggcggtggatcgg<br>gtggcgggggttcgggggcggcggctctgaagtgcagct<br>tcaacaatcaggaccaggactcgtcaaaccatcacagaccc<br>tctccctcacatgtgccatctccggggactccatgttgagcaa<br>ttccgacacttggaattggattagacaaagcccgtcccgggg<br>tctggaatggttgggacgcacctaccaccggtctacttggta<br>cgacgactacgcgtcatccgtgcggggaagagtgtccatca<br>acgtggacacctccaagaaccagtacagcctgcagcttaat<br>gccgtgactcctgaggatacgggcgtctactactgcgcccg<br>cgtccgcctgcaagacgggaacagctggagcgatgcattc<br>gatgtctggggccagggaactatggtcaccgtgtcgtctttg<br>gcagaagccgccgcgaaagaaattgtgatgacccagtcac<br>ccgccactcttagcctttcaccggtgagcgcgcaaccctgt<br>cttgcagagcctcccaagacatctcaaaatacctttaattggta<br>tcaacagaagcccggacaggctcctcgccttctgatctacca<br>caccagccggctccattctggaatccctgccaggttcagcg<br>gtagcggatctgggaccgactacaccctcactatcagctcac<br>tgcagccagaggacttcgctgtctatttctgtcagcaaggga<br>acaccctgccctacacctttggacagggcaccaagctcgag<br>attaaaggtggaggtggcagcggaggaggtgggtccggc<br>ggtggaggaagccaggtccaactccaagaaagcggaccg<br>ggtcttgtgaagccatcagaaactcttttcactgacttgtactgt<br>gagcggagtgtctctccccgattacggggtgtcttggatcag<br>acagccaccggggaagggtctggaatggattggagtgattt<br>ggggctctgagactacttactaccaatcatccctcaagtcac<br>gcgtcaccatctcaaaggacaactctaagaatcaggtgtcac<br>tgaaactgtcatctgtgaccgcagccgacaccgccgtgtact<br>attgcgctaagcattactattatggcgggagctacgcaatgg<br>attactggggacagggtactctggtcaccgtgtccagcacca<br>ctaccccagcaccgaggccacccaccccggctcctaccat<br>cgcctcccagcctctgtccctgcgtccggaggcatgtagac<br>ccgcagctggtggggccgtgcatacccggggtcttgacttc<br>gcctgcgatatctacatttgggcccctctggctggtacttgcg<br>gggtcctgctgctttcactcgtgatcactctttactgtaagcgc<br>ggtcggaagaagctgctgtacatctttaagcaaccccttcatga<br>ggcctgtgcagactactcaagaggaggacggctgttcatgc<br>cggttcccagaggaggaggaaggcggctgcgaactgcgc<br>gtgaaattcagccgcagcgcagatgctccagcctaccagca<br>ggggcagaaccagctctacaacgaactcaatcttggtcgga<br>gagaggagtacgacgtgctggacaagcggagaggacgg<br>gacccagaaatgggcgggaagccgcgcagaaagaatccc<br>caagagggcctgtacaacgagctccaaaaggataagatgg<br>cagaagcctatagcgagattggtatgaaagggggaacgcag<br>aagaggcaaaggccacgacggactgtaccagggactcag<br>caccgccaccaaggacacctatgacgctcttcacatgcagg<br>ccctgccgcctcggtaa |
| SEQ ID NO: 868 | Construct 185<br>(amino acid<br>sequence) | MALPVTALLLPLALLLHAARPQSALTQ<br>PASASGSPGQSVTISCTGTSSDVGGYN<br>YVSWYQQHPGKAPKLMIYDVSNRPSG<br>VSNRFSGSKSGNTASLTISGLQAEDEA<br>DYYCSSYTSSSTLYVFGTGTQLTVLGG<br>GGSGGGGSGGGGSEVQLQQSGPGLVK<br>PSQTLSLTCAISGDSMLSNSDTWNWIR<br>QSPSRGLEWLGRTYHRSTWYDDYASS<br>VRGRVSINVDTSKNQYSLQLNAVTPED<br>TGVYYCARVRLQDGNSWSDAFDVWG<br>QGTMVTVSS*LAEAAAK*EIVMTQSPATLS<br>LSPGERATLSCRASQDISKYLNWYQQK<br>PGQAPRLLIYHTSRLHSGIPARFSGSGS<br>GTDYTLTISSLQPEDFAVYFCQQGNTL<br>PYTFGQGTKLEIKGGGGSGGGGSGGG<br>GSQVQLQESGPGLVKPSETLSLTCTVS<br>GVSLPDYGVSWIRQPPGKGLEWIGVIW<br>GSETTYYQSSLKSRVTISKDNSKNQVS<br>LKLSSVTAADTAVYYCAKHYYYGGSY |

TABLE 15-continued

Amino acid and nucleic acid sequences of single CARs targeting CD22 and CD19.

|  |  |  |
|---|---|---|
|  |  | AMDYWGQGTLVTVSSTTTPAPRPPTP APTIASQPLSLRPEACRPAAGGAVHTR GLDFACDIYIWAPLAGTCGVLLLSLVIT LYCKRGRKKLLYIFKQPFMRPVQTTQE EDGCSCRFPEEEEGGCELRVKFSRSAD APAYQQGQNQLYNELNLGRREEYDVL DKRRGRDPEMGGKPRRKNPQEGLYNE LQKDKMAEAYSEIGMKGERRRGKGH DGLYQGLSTATKDTYDALHMQALPPR |
| SEQ ID NO: 869 | Construct 186 (nucleic acid sequence) | atggccctccctgtcaccgccctgctgcttccgctggctcttc tgctccacgccgctcggcccagtccgctcttacccaaccg gcctcagcctcggggagcccggccagagcgtgacctttt cctgcaccggcacttcatccgacgtgggcggctacaactac gtgtcctggtaccaacagcacccgggaaaggcccccaagc tcatgatctacgacgtgtccaacaggccctcgggagtgtcca accggttctcgggttcgaaatcgggaaacacagccagcctg accatcagcggactgcaggctgaagatgaagccgactacta ctgctcctcctacacctcgtcatccacgtctacgtgttcggc actggaactcagctgactgtgctgggggcggtggatcgg gtggcggggttcggggggcggcggctctgaagtgcagct tcaacaatcaggaccaggactcgtcaaccatcacagaccc tctccctcacatgtgccatctccggggactccatgttgagcaa ttccgacacttggaattggattagacaaagcccgtcccgggg tctggaatggttgggacgcacctaccaccggtctacttggta cgacgactacgcgtcatccgtgcggggaagagtgtccatca acgtggacacctccaagaaccagtacagcctgcagcttaat gccgtgactcctgaggatacgggcgtctactactgcgcccg cgtccgcctgcaagacgggaacagctggagcgatgcattc gatgtctggggccagggaactatggtcaccgtgtcgtctgg agggggagggagtgaaattgtgatgacccagtcacccgcc actcttagccttcacccggtgagcgcgcaaccctgtcttgca gagcctcccaagacatctcaaaatacctcaattggtatcaaca gaagcccggacaggctcctcgccttctgatctaccacacca gccggctccattctggaatccctgccaggttcagcggtagc ggatctgggaccgactacaccctcactatcagctcactgcag ccagaggacttcgctgtctatttctgtcagcaagggaacacc ctgcccttacacctttggacagggcaccaagctcgagattaaa ggtggaggtggcagcggaggaggtgggtccggcggtgga ggaagccaggtccaactccaagaaagcggacccgggtcttg tgaagccatcagaaactcttttcactgacttgtactgtgagcgg agtgtctctccccgattacggggtgtcttggatcagacagcc accggggaagggtctggaatggattggagtgatttgggct ctgagactacttactaccaatcatccctcaagtcacgcgtcac catctcaaaggacaactctaagaatcaggtgtcactgaaact gtcatctgtgaccgcagccgacaccgccgtgtactattgcgc taagcattactattatggcgggagctacgcaatggattactgg ggacagggtactctggtcaccgtgtccagcaccactacccc agcaccgaggccacccaccccggctcctaccatcgcctcc cagcctctgtccctgcgtccggaggcatgtagaccccgcagc tggtggggccgtgcatacccggggtcttgacttcgcctgcg atatctacatttgggcccctctggctggtacttgcgggtcct gctgctttcactcgtgatcactctttactgtaagcgcggtcgga agaagctgctgtacatctttaagcaacccttcatgaggcctgt gcagactactcaagaggaggacggctgttcatgccggttcc cagaggaggaggaaggcggctgcgaactgcgcgtgaaat tcagccgcagcgcagatgctccagcctaccagcaggggca gaaccagctctacaacgaactcaatcttggtcggagagagg agtacgacgtgctggacaagcggagaggacgggacccag aaatgggcgggaagccgcgcagaaagaatccccaagagg gcctgtacaacgagctccaaaaggataagatggcagaagc ctatagcgagattggtatgaaaggggaacgcagaagaggc aaaggccacgacggactgtaccagggactcagcaccgcc accaaggacacctatgacgctcttcacatgcaggccctgcc gcctcggtaa |
| SEQ ID NO: 870 | Construct 186 (amino acid sequence) | MALPVTALLLPLALLLHAARPQSALTQ PASASGSPGQSVTISCTGTSSDVGGYN YVSWYQQHPGKAPKLMIYDVSNRPSG VSNRFSGSKSGNTASLTISGLQAEDEA DYYCSSYTSSSTLYVFGTGTQLTVLGG GGSGGGGSGGGGSEVQLQQSGPGLVK PSQTLSLTCAISGDSMLSNSDTWNWIR QSPSRGLEWLGRTYHRSTWYDDYASS VRGRVSINVDTSKNQYSLQLNAVTPED TGVYYCARVRLQDGNSWSDAFDVWG QGTMVTVSSGGGGSEIVMTQSPATLSL SPGERATLSCRASQDISKYLNWYQQKP |

TABLE 15-continued

Amino acid and nucleic acid sequences of single CARs targeting CD22 and CD19.

|  |  |
|---|---|
|  | GQAPRLLIYHTSRLHSGIPARFSGSGSG<br>TDYTLTISSLQPEDFAVYFCQQGNTLP<br>YTFGQGTKLEIKGGGGSGGGGSGGGG<br>SQVQLQESGPGLVKPSETLSLTCTVSG<br>VSLPDYGVSWIRQPPGKGLEWIGVIWG<br>SETTYYQSSLKSRVTISKDNSKNQVSL<br>KLSSVTAADTAVYYCAKHYYYGGSY<br>AMDYWGQGTLVTVSSTTTPAPRPPTP<br>APTIASQPLSLRPEACRPAAGGAVHTR<br>GLDFACDIYIWAPLAGTCGVLLLSLVIT<br>LYCKRGRKKLLYIFKQPFMRPVQTTQE<br>EDGCSCRFPEEEEGGCELRVKFSRSAD<br>APAYQQGQNQLYNELNLGRREEYDVL<br>DKRRGRDPEMGGKPRRKNPQEGLYNE<br>LQKDKMAEAYSEIGMKGERRRGKGH<br>DGLYQGLSTATKDTYDALHMQALPPR |
| SEQ ID NO: 871 Construct 187<br>(nucleic acid<br>sequence) | atggcctccctgtcaccgccctgctgcttccgctggctcttc<br>tgctccacgccgctcggcccagtccgctcttacccaaccg<br>gcctcagcctcggggagcccggccagagcgtgaccattt<br>cctgcaccggcacttcatccgacgtgggcggctacaactac<br>gtgtcctggtaccaacagcacccgggaaaggccccccaagc<br>tcatgatctacgacgtgtccaacaggccctcgggagtgtcca<br>accggttctcgggttcgaaatcgggaaacacagccagcctg<br>accatcagcggactgcaggctgaagatgaagccgactacta<br>ctgctcctcctacacctcgtcatccacgctctacgtgttcggc<br>actggaactcagctgactgtgctgggcggaggaggctccg<br>aagtgcagcttcaacaatcaggaccaggactcgtcaaacca<br>tcacagaccctctccctcacatgtgccatctccggggactcc<br>atgttgagcaattccgacacttggaattggattagacaaagcc<br>cgtcccggggtctggaatggttgggacgcacctaccaccg<br>gtctacttggtacgacgactacgcgtcatccgtgcgggaa<br>gagtgtccatcaacgtggacacctccaagaaccagtacagc<br>ctgcagcttaatgccgtgactcctgaggatacgggcgtctac<br>tactgcgcccgcgtccgcctgcaagacgggaacagctgga<br>gcgatgcattcgatgtctggggccagggaactatggtcacc<br>gtgtcgtctttggcagaagccgccgcgaaagaaattgtgatg<br>acccagtcaccgccactcttagccttcaccggtgagcgc<br>gcaaccctgtcttgcagagcctcccaagacatctcaaaatac<br>cttaattggtatcaacagaagcccggacaggctcctcgcctt<br>ctgatctaccacaccagccggctccattctggaatccctgcc<br>aggttcagcggtagcggatctgggaccgactacaccctcac<br>tatcagctcactgcagccagaggacttcgctgtctatttctgtc<br>agcaagggaacaccctgccctacaccctttggacagggcac<br>caagctcgagattaaaggtggaggtggcagcggaggaggt<br>gggtccggcggtggaggaagccaggtccaactccaagaa<br>agcggaccgggtcttgtgaagccatcagaaactctttcactg<br>acttgtactgtgagcggagtgtctctcccgattacggggtgt<br>cttggatcagacagccaccggggaagggtctggaatggatt<br>ggagtgatttggggctctgagactacttactaccaatcatccc<br>tcaagtcacgcgtcaccatctcaaaggacaactctaagaatc<br>aggtgtcactgaaactgtcatctgtgaccgcagccgacacc<br>gccgtgtactattgcgctaagcattactattatggcgggagct<br>acgcaatggattactggggacagggtactctggtcaccgtgt<br>ccagcaccactaccccagcaccgaggccacccaccccgg<br>ctcctaccatcgcctcccagcctctgtccctgcgtccggagg<br>catgtagacccgcagctggtggggccgtgcataccggg<br>tcttgacttcgcctgcgatatctacatttgggcccctctggctg<br>gtacttgcggggtcctgctgctttcactcgtgatcactctttact<br>gtaagcgcggtcggaagaagctgctgtacatctttaagcaac<br>ccttcatgaggcctgtgcagactactcaagaggaggacgtgc<br>tgttcatgccggttcccagaggaggaggaaggcggctgcg<br>aactcgcgtgaaattcagccgcagcgcagatgctccagcc<br>taccagcaggggcagaaccagctctacaacgaactcaatct<br>tggtcggagagaggagtacgacgtgctggacaagcggag<br>aggacgggacccagaaatgggcgggaagccgcgcagaa<br>agaatccccaagagggcctgtacaacgagctccaaaagga<br>taagtggcagaagcctatagcgagattggtatgaaggggg<br>aacgcagaagaggcaaaggccacgacggactgtaccagg<br>gactcagcaccgccaccaaggacacctatgacgctcttcac<br>atgcaggccctgccgcctcggtaa |
| SEQ ID NO: 872 Construct 187<br>(amino acid<br>sequence) | MALPVTALLLPLALLLHAARPQSALTQ<br>PASASGSPGQSVTISCTGTSSDVGGYN<br>YVSWYQQHPGKAPKLMIYDVSNRPSG<br>VSNRFSGSKSGNTASLTISGLQAEDEA<br>DYYCSSYTSSSTLYVFGTGTQLTVLGG<br>GGSEVQLQQSGPGLVKPSQTLSLTCAIS |

TABLE 15-continued

Amino acid and nucleic acid sequences of single CARs targeting CD22 and CD19.

|  |  |
|---|---|
|  | GDSMLSNSDTWNWIRQSPSRGLEWLG RTYHRSTWYDDYASSVRGRVSINVDT SKNQYSLQLNAVTPEDTGVYYCARVR LQDGNSWSDAFDVWGQGTMVTVSS*SL AEAAAK*EIVMTQSPATLSLSPGERATLS CRASQDISKYLNWYQQKPGQAPRLLIY HTSRLHSGIPARFSGSGSGTDYTLTISSL QPEDFAVYFCQQGNTLPYTFGQGTKLE IKGGGGSGGGGSGGGGSQVQLQESGP GLVKPSETLSLTCTVSGVSLPDYGVSW IRQPPGKGLEWIGVIWGSETTYYQSSL KSRVTISKDNSKNQVSLKLSSVTAADT AVYYCAKHYYYGGSYAMDYWGQGT LVTVSSTTTPAPRPPTPAPTIASQPLSLR PEACRPAAGGAVHTRGLDFACDIYIW APLAGTCGVLLLSLVITLYCKRGRKKL LYIFKQPFMRPVQTTQEEDGCSCRFPEE EEGGCELRVKFSRSADAPAYQQGQNQ LYNELNLGRREEYDVLDKRRGRDPEM GGKPRRKNPQEGLYNELQKDKMAEA YSEIGMKGERRRGKGHDGLYQGLSTA TKDTYDALHMQALPPR |
| SEQ ID NO: 873 Construct 188 (nucleic acid sequence) | atggccctccctgtcaccgccctgctgcttccgctggctcttc tgctccacgccgctcggcccagtccgctcttacccaaccg gcctcagcctcggggagcccccggccagagcgtgaccattt cctgcaccggcacttcatccgacgtgggcggctacaactac gtgtcctggtaccaacagcaccgggaaaggcccccaagc tcatgatctacgacgtgtccaacaggccctcgggagtgtcca accggttctcgggttcgaaatcgggaaacacagccagcctg accatcagcggactgcaggctgaagatgaagccgactacta ctgctcctcctacacctcgtcatccacgctctacgtgttcggc actggaactcagctgactgtgctgggcggaggaggctccg aagtgcagcttcaacaatcaggaccaggactcgtcaaacca tcacagaccctctccctcacatgtgccatctccggggactcc atgttgagcaattccgacactttggaattggattagacaaagcc cgtcccggggtctggaatggttgggacgcacctaccaccg gtctacttggtacgacgactacgcgtcatccgtgcggggaa gagtgtccatcaacgtggacacctccaagaaccagtacagc ctgcagcttaatgccgtgactcctgaggatacgggcgtctac tactgcgcccgcgtccgcctgcaagacgggaacagctgga gcgatgcattcgatgtctggggccagggaactatggtcacc gtgtcgtctggagggggaggggagtgaaattgtgatgaccca gtcacccgccactcttagccttcaccggtgagcgcgcaac cctgtcttgcagagcctcccaagacatctcaaaataccttaatt ggtatcaacagaagcccggacaggctcctcgccttctgatct accacaccagccggctccattctggaatccctgccaggttca gcggtagcggatctgggaccgactacaccctcactatcagc tcactgcagccagaggacttcgctgtctatttctgtcagcaag ggaacaccctgccctacacctttggacagggcaccaagctc gagattaaaggtggaggtggcagcggaggaggtgggtcc ggcggtggaggaagccaggtccaactccaagaaagcgga ccgggtcttgtgaagccatcagaaactctttcactgacttgta ctgtgagcggagtgtctctccccgattacggggtgtcttggat cagacagccaccggggaagggtctggaatggattggagtg atttggggctctgagactacttactaccaatcatccctcaagtc acgcgtcaccatctcaaaggacaactctaagaatcaggtgtc actgaaactgtcatctgtgaccgcagccgacaccgccgtgt actattgcgctaagcattactattatggcgggagctacgcaat ggattactggggacagggtactctggtcaccgtgtccagca ccactaccccagcaccgaggccacccaccccggctcctac catcgcctcccagcctctgtccctgcgtccggaggcatgtag acccgcagctggtggggccgtgcatcccggggtcttgact tcgcctgcgatatctacatttgggcccctctggctggtacttgc ggggtcctgctgctttcactcgtgatcactctttactgtaagcg cggtcggaagaagctgctgtacatctttaagcaacccttcatg aggcctgtgcagactactcaagaggaggacggctgttcatg ccggttcccagaggaggaggaaggcggctgcgaactgcg cgtgaaattcagccgcagcgcagatgctccagcctaccagc aggggcagaaccagctctacaacgaactcaatcttggtcgg agagaggagtacgacgtgctggacaagcgggaggacgg gacccagaaatgggcgggaagccgcgcagaaagaatccc caagagggcctgtacaacgagctccaaaaggataagatgg cagaagcctatagcgagattggtatgaaagggggaacgcag aagaggcaaaggccacgacggactgtaccagggactcag caccgccaccaaggacacctatgacgctcttcacatgcagg ccctgccgcctcggtaa |

TABLE 15-continued

Amino acid and nucleic acid sequences of single CARs targeting CD22 and CD19.

| SEQ ID NO: 874 | Construct 188 (amino acid sequence) | MALPVTALLLPLALLLHAARPQSALTQ PASASGSPGQSVTISCTGTSSDVGGYN YVSWYQQHPGKAPKLMIYDVSNRPSG VSNRFSGSKSGNTASLTISGLQAEDEA DYYCSSYTSSSTLYVFGTGTQLTVLGG GGSEVQLQQSGPGLVKPSQTLSLTCAIS GDSMLSNSDTWNWIRQSPSRGLEWLG RTYHRSTWYDDYASSVRGRVSINVDT SKNQYSLQLNAVTPEDTGVYYCARVR LQDGNSWSDAFDVWGQGTMVTVSSG GGGSEIVMTQSPATLSLSPGERATLSCR ASQDISKYLNWYQQKPGQAPRLLIYHT SRLHSGIPARFSGSGSGTDYTLTISSLQP EDFAVYFCQQGNTLPYTFGQGTKLEIK GGGGSGGGGSGGGGSQVQLQESGPGL VKPSETLSLTCTVSGVSLPDYGVSWIR QPPGKGLEWIGVIWGSETTYYQSSLKS RVTISKDNSKNQVSLKLSSVTAADTAV YYCAKHYYYGGSYAMDYWGQGTLV TVSSTTTPAPRPPTPAPTIASQPLSLRPE ACRPAAGGAVHTRGLDFACDIYIWAP LAGTCGVLLLSLVITLYCKRGRKKLLY IFKQPFMRPVQ TTQEEDGCSCRFPEEEEGGCELRVKFS RSADAPAYQQGQNQLYNELNLGRREE YDVLDKRRGRDPEMGGKPRRKNPQEG LYNELQKDKMAEAYSEIGMKGERRRG KGHDGLYQGLSTATKDTYDALHMQA LPPR* |

| SEQ ID NO: | CD19/CD22 CAR Component | Sequence |
|---|---|---|
| SEQ ID NO: 875 | Linker (amino acid sequence) | GGGGS |
| SEQ ID NO: 876 | Alternative linker (amino acid sequence) | LAEAAAK |
| SEQ ID NO: 877 | Signal peptide (nucleic acid sequence) | atggccctccctgtcaccgccctgctgcttccgctggctcttc tgctccacgccgctcggccc |
| SEQ ID NO: 878 | Signal peptide (amino acid sequence) | MALPVTALLLPLALLLHAARP |
| SEQ ID NO: 879 | CD19 scFv (nucleic acid sequence) | gaaattgtgatgacccagtcacccgccactcttagcctttcac ccggtgagcgcgcaaccctgtcttgcagagcctcccaagac atctcaaaataccttaattggtatcaacagaagcccggacag gctcctcgcctttctgatctaccacaccagccggctccattctg gaatccctgccaggttcagcggtagcggatctgggaccgac tacacccctcactatcagctcactgcagccagaggacttcgct gtctatttctgtcagcaagggaacacccctgccctacacctttg gacagggcaccaagctcgagattaaaggtggaggtggcag cggaggaggtgggtccggcggtggaggaagccaggtcca actccaagaaagcggaccgggtcttgtgaagccatcagaaa ctctttcactgacttgtactgtgagcggagtgtctctccccgat tacggggtgtcttggatcagacagccaccggggaagggtct ggaatggattggagtgatttggggctctgagactacttactac caatcatccctcaagtcacgcgtcaccatctcaaaggacaac tctaagaatcaggtgtcactgaaactgtcatctgtgaccgcag ccgacaccgccgtgtactattgcgctaagcattactattatgg cggagctacgcaatggattactggggacagggtactctgg tcaccgtgtccagc |
| SEQ ID NO: 880 | CD19 scFV (amino acid sequence; linker shown by italics and underline) | EIVMTQSPATLSLSPGERATLSCRASQD ISKYLNWYQQKPGQAPRLLIYHTSRLH SGIPARFSGSGSGTDYTLTISSLQPEDFA VYFCQQGNTLPYTFGQGTKLEIK*GGG GSGGGGSGGGGS*QVQLQESGPGLVKPS ETLSLTCTVSGVSLPDYGVSWIRQPPG KGLEWIGVIWGSETTYYQSSLKSRVTIS KDNSKNQVSLKLSSVTAADTAVYYCA KHYYYGGSYAMDYWGQGTLVTVSS |

TABLE 15-continued

Amino acid and nucleic acid sequences of single CARs targeting CD22 and CD19.

SEQ ID NO: 881 CD22 scFv in heavy/light orientation (nucleic acid sequence)

```
gaagtgcagcttcaacaatcaggaccaggactcgtcaaacc
atcacagaccctctccctcacatgtgccatctccggggactc
catgttgagcaattccgacacttggaattggattagacaaagc
ccgtcccggggtctggaatggttgggacgcacctaccaccg
gtctacttggtacgacgactacgcgtcatccgtgcggggaa
gagtgtccatcaacgtggacacctccaagaaccagtacagc
ctgcagcttaatgccgtgactcctgaggatacgggcgtctac
tactgcgcccgcgtccgcctgcaagacgggaacagctgga
gcgatgcattcgatgtctggggccagggaactatggtcacc
gtgtcgtctgggggcggtggatcgggtggcgggggttcgg
ggggcggcggctctcagtccgctcttacccaaccggcctca
gcctcggggagccccggccagagcgtgaccatttcctgca
ccggcacttcatccgacgtgggcggctacaactacgtgtcct
ggtaccaacagcacccgggaaaggcccccaagctcatgat
ctacgacgtgtccaacaggccctcgggagtgtccaaccggt
tctcggggttcgaaatcgggaaacacagccagcctgaccatc
agcggactgcaggctgaagatgaagccgactactactgctc
ctcctacacctcgtcatccacgctctacgtgttcggcactgga
actcagctgactgtgctg
```

SEQ ID NO: 882 CD22 scFv in heavy/light orientation (amino acid sequence; linker shown by italics and underline)

EVQLQQSGPGLVKPSQTLSLTCAISGDS
MLSNSDTWNWIRQSPSRGLEWLGRTY
HRSTWYDDYASSVRGRVSINVDTSKN
QYSLQLNAVTPEDTGVYYCARVRLQD
GNSWSDAFDVWGQGTMVTVSS*GGGG*
*SGGGGSGGGGS*QSALTQPASASGSPGQ
SVTISCTGTSSDVGGYNYVSWYQQHP
GKAPKLMIYDVSNRPSGVSNRFSGSKS
GNTASLTISGLQAEDEADYYCSSYTSSS
TLYVFGTGTQLTVL

SEQ ID NO: 883 CD22 scFv in heavy/light orientation with shorter (GGGGS (SEQ ID NO: 1083)) linker between heavy/light chains (nucleic acid sequence)

```
gaagtgcagcttcaacaatcaggaccaggactcgtcaaacc
atcacagaccctctccctcacatgtgccatctccggggactc
catgttgagcaattccgacacttggaattggattagacaaagc
ccgtcccggggtctggaatggttgggacgcacctaccaccg
gtctacttggtacgacgactacgcgtcatccgtgcggggaa
gagtgtccatcaacgtggacacctccaagaaccagtacagc
ctgcagcttaatgccgtgactcctgaggatacgggcgtctac
tactgcgcccgcgtccgcctgcaagacgggaacagctgga
gcgatgcattcgatgtctggggccagggaactatggtcacc
gtgtcgtctggcggaggaggctcccagtccgctcttaccca
accggcctcagcctcggggagccccggccagagcgtgac
catttcctgcaccggcacttcatccgacgtgggcggctacaa
ctacgtgtcctggtaccaacagcacccgggaaaggccccc
aagctcatgatctacgacgtgtccaacaggccctcgggagt
gtccaaccggttctcggggttcgaaatcgggaaacacagcca
gcctgaccatcagcggactgcaggctgaagatgaagccga
ctactactgctcctcctacacctcgtcatccacgctctacgtgt
tcggcactggaactcagctgactgtgctg
```

SEQ ID NO: 884 CD22 scFv in heavy/light orientation with shorter (GGGGS) (SEQ ID NO: 1083) linker between heavy/light chains (amino acid sequence; linker shown by italics and underline)

EVQLQQSGPGLVKPSQTLSLTCAISGDS
MLSNSDTWNWIRQSPSRGLEWLGRTY
HRSTWYDDYASSVRGRVSINVDTSKN
QYSLQLNAVTPEDTGVYYCARVRLQD
GNSWSDAFDVWGQGTMVTVSS*GGGG*
*S*QSALTQPASASGSPGQSVTISCTGTSS
DVGGYNYVSWYQQHPGKAPKLMIYD
VSNRPSGVSNRFSGSKSGNTASLTISGL
QAEDEADYYCSSYTSSSTLYVFGTGTQ
LTVL

SEQ ID NO: 885 CD22 scFV in light/heavy orientation (nucleic acid sequence)

```
cagtccgctcttacccaaccggcctcagcctcggggagccc
cggccagagcgtgaccatttcctgcaccggcacttcatccg
acgtgggcggctacaactacgtgtcctggtaccaacagcac
ccgggaaaggccccaagctcatgatctacgacgtgtccaa
caggccctcgggagtgtccaaccggttctcggggttcgaaat
cgggaaacacagccagcctgaccatcagcggactgcagg
ctgaagatgaagccgactactactgctcctcctacacctcgtc
atccacgctctacgtgttcggcactggaactcagctgactgt
gctgggggcggtggatcggtggcgggggttcgggggg
cggcggctctgaagtgcagcttcaacaatcaggaccagga
ctcgtcaaaccatcacagaccctctccctcacatgtgccatct
ccggggactccatgttgagcaattccgacacttggaattgga
ttagacaaagcccgtcccggggtctggaatggttgggacgc
acctaccaccggtctacttggtacgacgactacgcgtcatcc
gtgcggggaagagtgtccatcaacgtggacacctccaaga
```

TABLE 15-continued

Amino acid and nucleic acid sequences of single CARs targeting CD22 and CD19.

|  |  |  |
|---|---|---|
|  |  | accagtacagcctgcagcttaatgccgtgactcctgaggata cgggcgtctactactgcgcccgcgtccgcctgcaagacgg gaacagctggagcgatgcattcgatgtctggggccaggga actatggtcaccgtgtcgtct |
| SEQ ID NO: 886 | CD22 scFV in light/heavy orientation (amino acid sequence; linker shown by italics and underline) | QSALTQPASASGSPGQSVTISCTGTSSD VGGYNYVSWYQQHPGKAPKLMIYDV SNRPSGVSNRFSGSKSGNTASLTISGLQ AEDEADYYCSSYTSSSTLYVFGTGTQL TVL*GGGGSGGGGSGGGGS*EVQLQQSG PGLVKPSQTLSLTCAISGDSMLSNSDT WNWIRQSPSRGLEWLGRTYHRSTWYD DYASSVRGRVSINVDTSKNQYSLQLNA VTPEDTGVYYCARVRLQDGNSWSDAF DVWGQGTMVTVSS |
| SEQ ID NO: 887 | CD22 scFv in light/heavy orientation with shorter linker (GGGGS (SEQ ID NO: 1083)) between light and heavy chains (nucleic acid sequence) | cagtccgctcttacccaaccggcctcagcctcggggagccc cggccagagcgtgaccatttcctgcaccggcacttcatccg acgtgggcggctacaactacgtgtcctggtaccaacagcac ccgggaaaggccccaagctcatgatctacgacgtgtccaa caggccctcgggagtgtccaaccggttctcgggttcgaaat cgggaaacacagccagcctgaccatcagcggactgcagg ctgaagatgaagccgactactactgctcctcctacacctcgtc atccacgctctacgtgttcggcactggaactcagctgactgt gctgggcggaggaggctccgaagtgcagcttcaacaatca ggaccaggactcgtcaaaccatcacagaccctctccctcac atgtgccatctccggggactccatgttgagcaattccgacact tggaattggattagacaaagccgtcccggggtctggaatg gttgggacgcacctaccaccggtctacttggtacgacgacta cgcgtcatccgtgcggggaagagtgtccatcaacgtggaca cctccaagaaccagtacagcctgcagcttaatgccgtgactc ctgaggatacgggcgtctactactgcgcccgcgtccgcctg caagacgggaacagctggagcgatgcattcgatgtctggg gccagggaactatggtcaccgtgtcgtct |
| SEQ ID NO: 888 | CD22 scFv in light/heavy orientation with shorter linker (GGGGS (SEQ ID NO: 1083)) between light and heavy chains (amino acid sequence; linker shown by italics and underline) | QSALTQPASASGSPGQSVTISCTGTSSD VGGYNYVSWYQQHPGKAPKLMIYDV SNRPSGVSNRFSGSKSGNTASLTISGLQ AEDEADYYCSSYTSSSTLYVFGTGTQL TVL*GGGGS*EVQLQQSGPGLVKPSQTLS LTCAISGDSMLSNSDTWNWIRQSPSRG LEWLGRTYHRSTWYDDYASSVRGRVS INVDTSKNQYSLQLNAVTPEDTGVYY CARVRLQDGNSWSDAFDVWGQGTMV TVSS |
| SEQ ID NO: 889 | Hinge and transmembrane domain (nucleic acid sequence) | accactaccccagcaccgaggccacccaccccggctccta ccatcgcctcccagcctctgtccctgcgtccggaggcatgta gacccgcagctggtggggccgtgcatacccggggtcttga cttcgcctgcgatatctacatttgggcccctctggctggtactt gcggggtcctgctgctttcactcgtgatcactcttactgt |
| SEQ ID NO: 890 | Hinge and transmembrane domain (amino acid sequence) | TTTPAPRPPTPAPTIASQPLSLRPEACRP AAGGAVHTRGLDFACDIYIWAPLAGT CGVLLLSLVITLYC |
| SEQ ID NO: 891 | 4-1BB (nucleic acid sequence) | aagcgcggtcggaagaagctgctgtacatctttaagcaacc cttcatgaggcctgtgcagactactcaagaggaggacggct gttcatgccggttcccagaggaggaggaagcggctgcga actg |
| SEQ ID NO: 892 | 4-1BB (amino acid sequence) | KRGRKKLLYIFKQPFMRPVQTTQEEDG CSCRFPEEEEGGCEL |
| SEQ ID NO: 893 | CD3zeta (nucleic acid sequence) | cgcgtgaaattcagccgcagcgcagatgctccagcctacca gcaggggcagaaccagctctacaacgaactcaatcttggtc ggagagaggagtacgacgtgctggacaagcgggagggac gggacccagaaatgggcgggaagccgcgcagaaagaatc cccaagagggcctgtacaacgagctccaaaaggataagat ggcagaagcctatagcgagattggtatgaaggggaacgc agaagaggcaaaggccacgacggactgtaccagggactc agcaccgccaccaaggacacctatgacgctcttcacatgca ggccctgccgcctcggtaa |
| SEQ ID NO: 894 | CD3zeta (amino acid sequence) | RVKFSRSADAPAYQQGQNQLYNELNL GRREEYDVLDKRRGRDPEMGGKPRRK |

TABLE 15-continued

Amino acid and nucleic acid sequences of single CARs targeting CD22 and CD19.

NPQEGLYNELQKDKMAEAYSEIGMKG
ERRRGKGHDGLYQGLSTATKDTYDAL
HMQALPPR*

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples specifically point out various aspects of the present invention, and are not to be construed as limiting in any way the remainder of the disclosure.

Example 1: Generation of Mouse Anti-Human CD20 Monoclonal Antibodies

A panel of monoclonal antibodies to human CD20 target has been generated and selected by a cell-based immunization approach (Proetzel G, Ebersbach H and Zhang C., Methods Mol Biol, 901:1-10, 2012). Human CD20 was transfected and expressed on the surface of 300-19 cells, a mouse pre-B cell line. The CD20-transfected 300-19 cells were used as antigens for the immunization of mice and for the subsequent screening of specific hybridoma antibodies after cell fusion.

Animal immunization and sample collection were carried out according to the IACUC-approved standard animal use protocols (12 NBC 059). Briefly, female Balb/c VAF mice at the age of 5-6 weeks (Charles River Laboratories) were immunized with human CD20-transfected 300-19 cells. The mice were subcutaneously immunized for 4 times with approximately $5 \times 10^6$ cells in 100 μL of phosphate-buffered saline (PBS) per animal. The injection was performed every 2-3 weeks to develop immune responses in the animals. Three days before cell fusion for the hybridoma generation, the mice were intraperitoneally boosted with the same dose of cell-based antigens, and were euthanized for the spleen collection under sterilized surgical conditions on the day of cell fusion.

Spleens from the immunized mice were used for preparation of single cell suspension in RPMI-1640 medium. The spleen cells were pelleted and washed twice with RPMI-1640 medium. For cell fusions to generate hybridoma clones, the splenocytes were mixed and fused with murine myeloma P3X63Ag8.653 cells (Kearney J. F. et al., 1979. J. Immunol., 123:1548-1550) using polyethylene glycol-1500 as fusogen according to our standard fusion protocols (Zhang C., Methods Mol. Biol. 901:117-135, 2012). Following cell fusions and centrifugation, the cells were suspended in complete RPMI-1640 culture medium (200 mL/spleen) containing hypoxanthine-aminopterin-thymidine (HAT) supplement (Sigma H-0262), and were plated into 96-well flat-bottom plates (Corning-Costar 3596) at 200 μL of cell suspension per well.

Following incubation at 37° C., 5% $CO_2$ for 3-4 days, 100 μL of culture supernatant were removed from each well of the plates and replaced with an equal volume of complete RPMI-1640 culture medium containing hypoxanthine-thymidine (HT) supplement (Sigma H-0137). The plates continued to be incubated in an atmosphere of 5% $CO_2$ at 37° C. until hybridoma clones had grown large enough colonies for antibody screening.

Hybridoma Screening, Subcloning and Selection

On week 2 post-fusion when hybridoma cells had grown to be half-confluent in the plate wells and the culture supernatant had changed to an orange color, hybridoma supernatants were sampled from the culture plates for antibody screening by immunofluorescence flow cytometry. For primary screening, hybridoma supernatants were analyzed by flow cytometry using human CD20-transfected 300-19 cells versus non-transfected 300-19 cells. Briefly, human CD20-transfected 300-19 cells or the non-transfected cells were respectively incubated with 50 μL of hybridoma supernatant, followed by labeling with fluorescein-AffiniPure Fab fragment goat anti-mouse IgG (H+L) conjugate and analyzed by flow cytometry with Becton Dickinson FACSCalibur in an automatic mode.

By flow cytometric analysis, hybridoma clones that reacted with human CD20-transfected 300-19 cells but not with non-transfected 300-19 cells were identified and selected from culture plates. The desired hybridoma clones were expanded in T12 plates for further characterization. Hybridoma clone of interest was subcloned by limiting dilution and by picking single colonies with a Cellavista imaging system to attain a monoclonal population that produces a CD20-specific antibody. The selected hybridoma subclones were expanded in T12 plates and frozen for cryopreservation or used for monoclonal antibody production. The isotype of specific monoclonal antibodies derived from hybridoma clones was tested by using commercially-available isotyping reagents to determine the antibody property.

On the basis of screening results, a panel of 19 human CD20-specific hybridoma clones was identified and selected from the immunization of mice with human CD20 antigen (data not shown). The hybridoma antibodies were further tested on human tumor tissues or cell lines to identify the top clones for antibody sequencing and humanization based on its binding profile and biological property.

Example 2: Humanization of Mouse scFv

The top clones were humanized according standard methods, well known to a person skilled in the art (Jones et al., Nature, 321: 522-525, 1986; Reichmann et al., Nature, 332: 323-329, 1988; Presta, Curr. Op. Struct. Biol., 2: 593-596, 1992).

The antigen-binding site comprises the complementarity determining regions (CDRs) and positions outside the CDR, i.e. in the framework region of the variable domains (VL and VH) that directly or indirectly affect binding. Framework residues that may directly affect binding can, for example, be found in the so called "outer" loop region located between CDR2 and CDR3. Residues that indirectly affect binding are for example found at so called Vernier Zones (Foote and Winter 1992). They are thought to support CDR conformation. Those positions outside the CDRs were taken into account when choosing a suitable acceptor framework to minimize the number of deviations of the final humanized antibody to the human germline acceptor sequence in the framework regions.

Example 3: Analysis and In Vitro Activity of Humanized Anti-CD20 scFv Bearing CARTs Humanized, murine single chain variable fragments (scFv) specific for CD20, generated as described in the examples above, were cloned into lentiviral CAR expression vectors comprising the CD3zeta chain and the 4-1BB stimulatory molecules; CD20-C2H1, -C2H2, -C2H3, -C2H4, -C3H1, -C3H2, -C3H3, -C3H4, -C5H1, -C5H2, -C5H3, -C5H4, -C8H1, -C8H2, -C8H3, and -C8H4. A rat scFv-derived CAR CD20-3 and its humanized derivatives -CD20-3m, -3J, -3H5k1, and -3H5k3 as well as the CD20-8aBBz CAR, based on the scFv of a published CAR (Jensen et al., Mol. Ther., 2000, incorporated here by reference), were included as controls. In addition, a CAR was constructed, which was based on the variable regions of the Ofatumumab monoclonal antibody (CD20-Ofa) (CAS registry number: 679818-59-8, Drug bank accession number: DB06650). All the CD20 CARs are set forth in Table 1. The optimal constructs were selected based on the quantity and quality of the effector T cell responses of these CD20 CAR-transduced T cells ("CD20 CART" or "CD20 CAR T cells") in response to CD20 expressing ("CD20+" or "CD20 positive") targets. Effector T cell responses include, but are not limited to, cellular expansion, proliferation, doubling, cytokine production, and target cell killing or cytolytic activity (degranulation).

Generation of CD20 CAR Lentivirus

Humanized scFv encoding lentiviral transfer vectors were used to produce the genomic material packaged into the VSVg pseudotyped lentiviral particles. Lentiviral transfer vector DNA encoding the CAR was mixed with the three packaging components VSVg, gag/pol and rev in combination with lipofectamine reagent to transfect Lenti-X 293T cells (Clontech), followed by medium replacement 12-18 h later. 30 hours after medium change, the media is collected, filtered and stored at −80° C.

Alternatively, lentivirus encoding for CD20 CARs was generated in an automated, small scale fashion in 96-well plates, where virus-containing supernatant was used fresh, without freezing, for the transduction of a Jurkat T cell reporter cell line.

Generation of CD20 CAR JNL Cells

The Jurkat NFAT Luciferase (JNL) reporter cell line is based on the acute T cell leukemia line Jurkat (RRID: CVCL_0367). The line was modified to express luciferase under control of the Nuclear Factor of Activated T cells (NFAT) response element. For the transduction with CD20 CARs, 10,000 JNL cells/well of a 96-well plate were transduced with 50 µl of fresh, 45 m-filtered virus-containing supernatant. The plates were spun for 3 min at 2000 rpm and cultured for 4 days.

Evaluating Efficacy of CD20 CAR-Redirected JNL Cells

To evaluate the functional ability of CD20 CARs to activate JNL cells, they were co-cultured with target cancer cells to read out their activation by quantifying luciferase expression. The humanized scFv-based CARs CD20-C2H1, -C2H2, -C2H3, -C2H4, -C3H1, -C3H2, -C3H3, -C3H4, -C5H1, -C5H2, -C5H3, -C5H4, -C8H1, -C8H2, -C8H3, and -C8H4, were compared to CD20-8aBBz and CD20-3, -3m, -3J, -3H5k3, and -3H5k1. The control CARs CD20-3 and CD20-8aBBz were used in all assays to compare assay variation and/or act as a control. The EGFRvIII CAR T cells (CAR 2174, Johnson et al., Science Translational Medicine 2015) were used as non-targeting control.

Figure 1A:
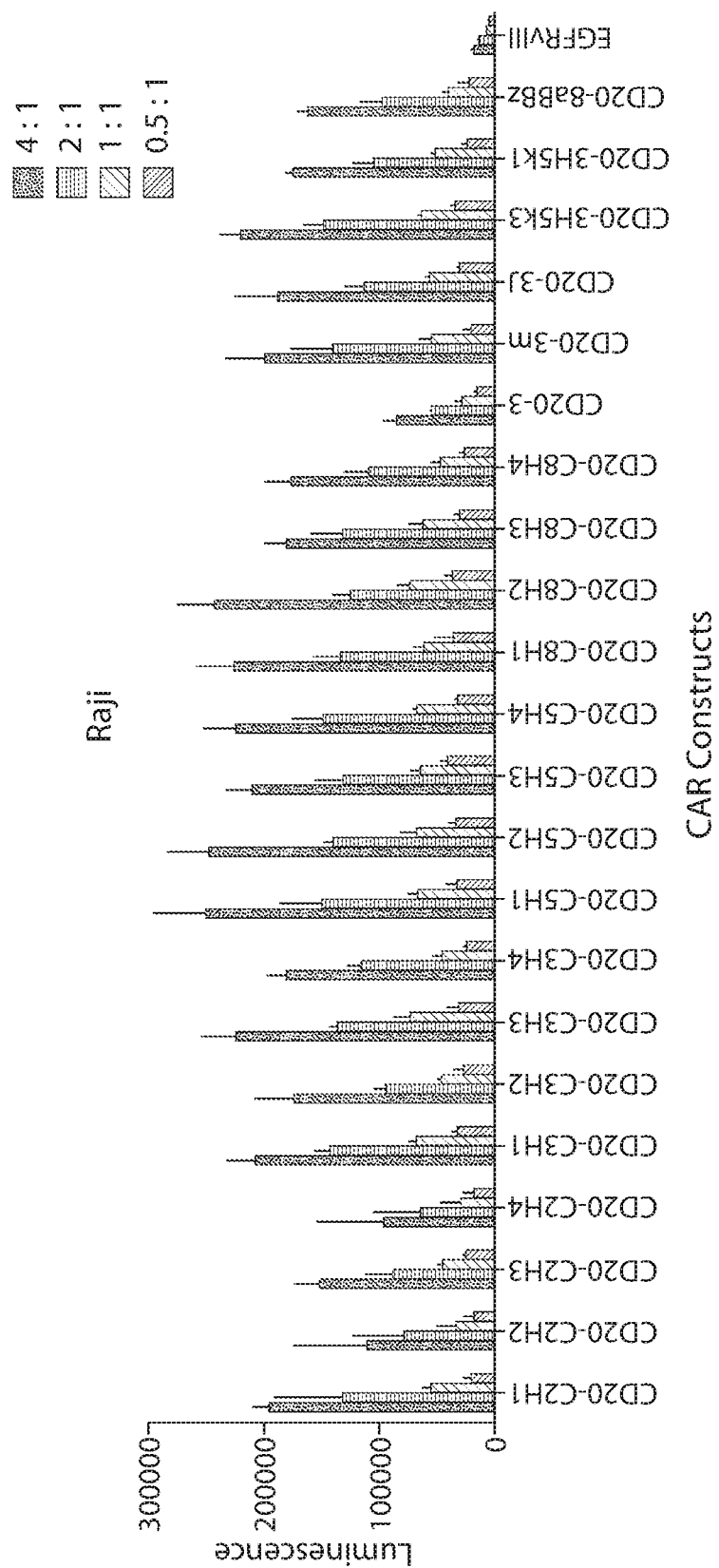
FIGS. 1A-1E are graphs showing a Jurkat NFAT Luciferase (JNL) reporter assay testing the function of CD20 CARs. CD20 JNL CAR T cells were cocultured with the Burkitt's lymphoma line Raji and the diffuse large B cell lymphoma (DLBCL) lines Pfeiffer, HBL-1 and TMD8; K562, a chronic myelogenous leukemia (CML) cell line, served as CD20-negative control. Luminescence read-out is a direct measurement of CAR stimulation. All four target cell lines demonstrate activation of all humanized CD20 CARs (FIGS. 1A-D). None of the humanized mouse CARs showed activation by the CD20-negative line K562 (FIG. 1E).
Figure 1B:
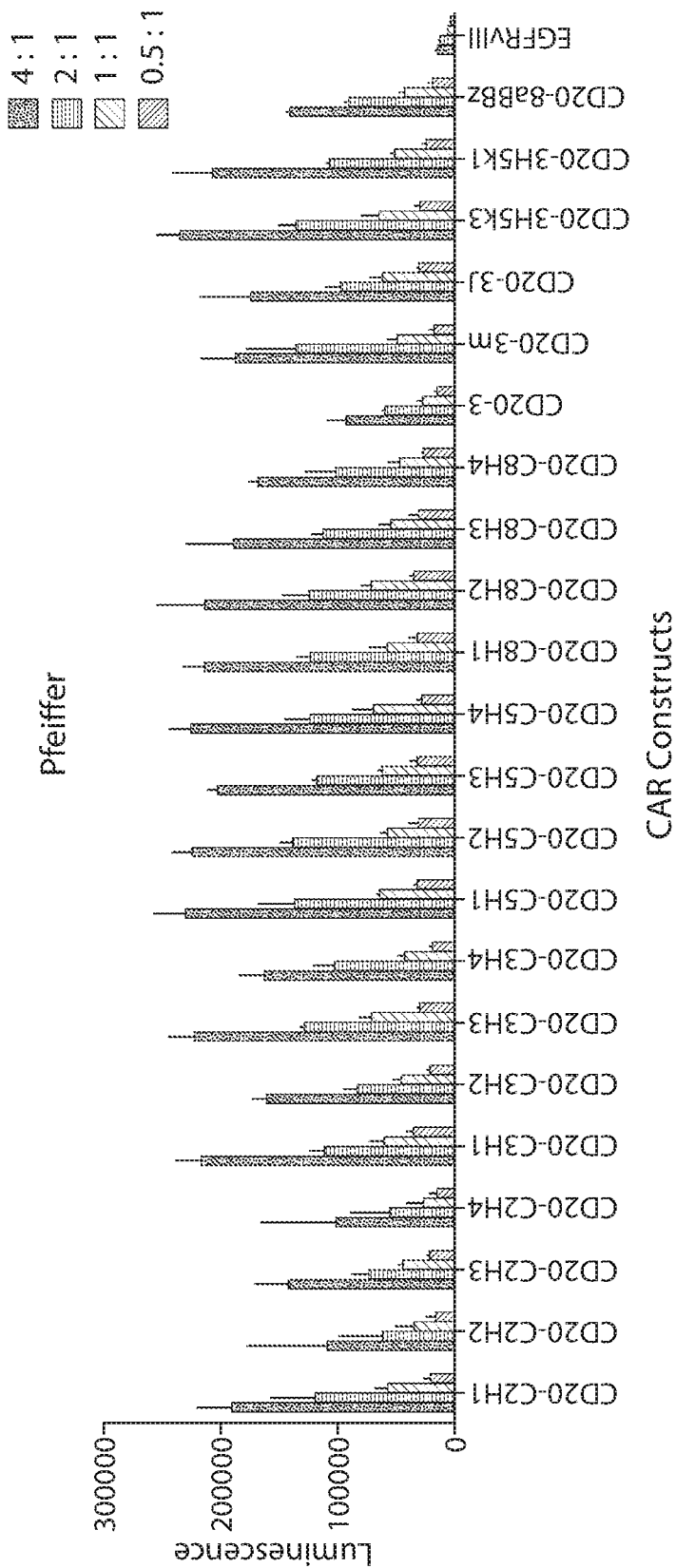
Figure 1C:
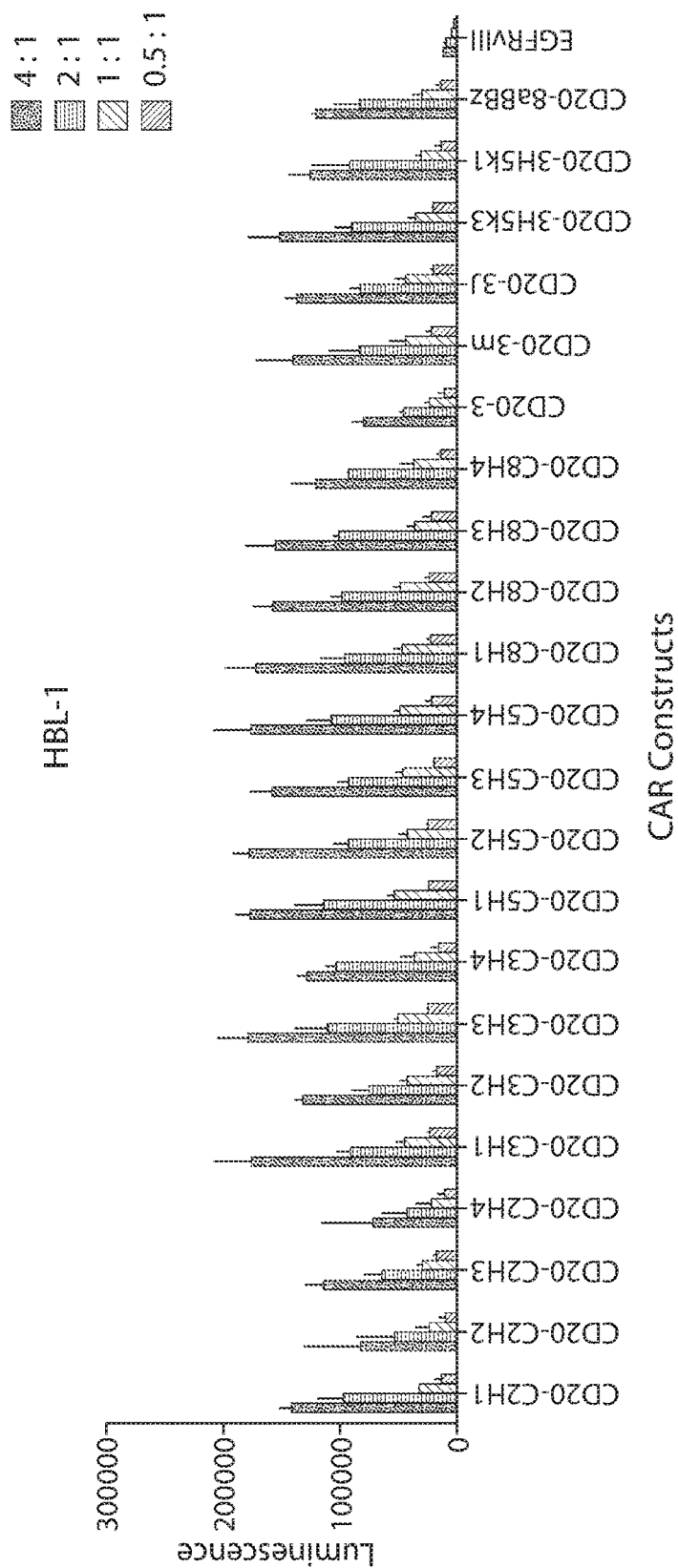
Figure 1D:
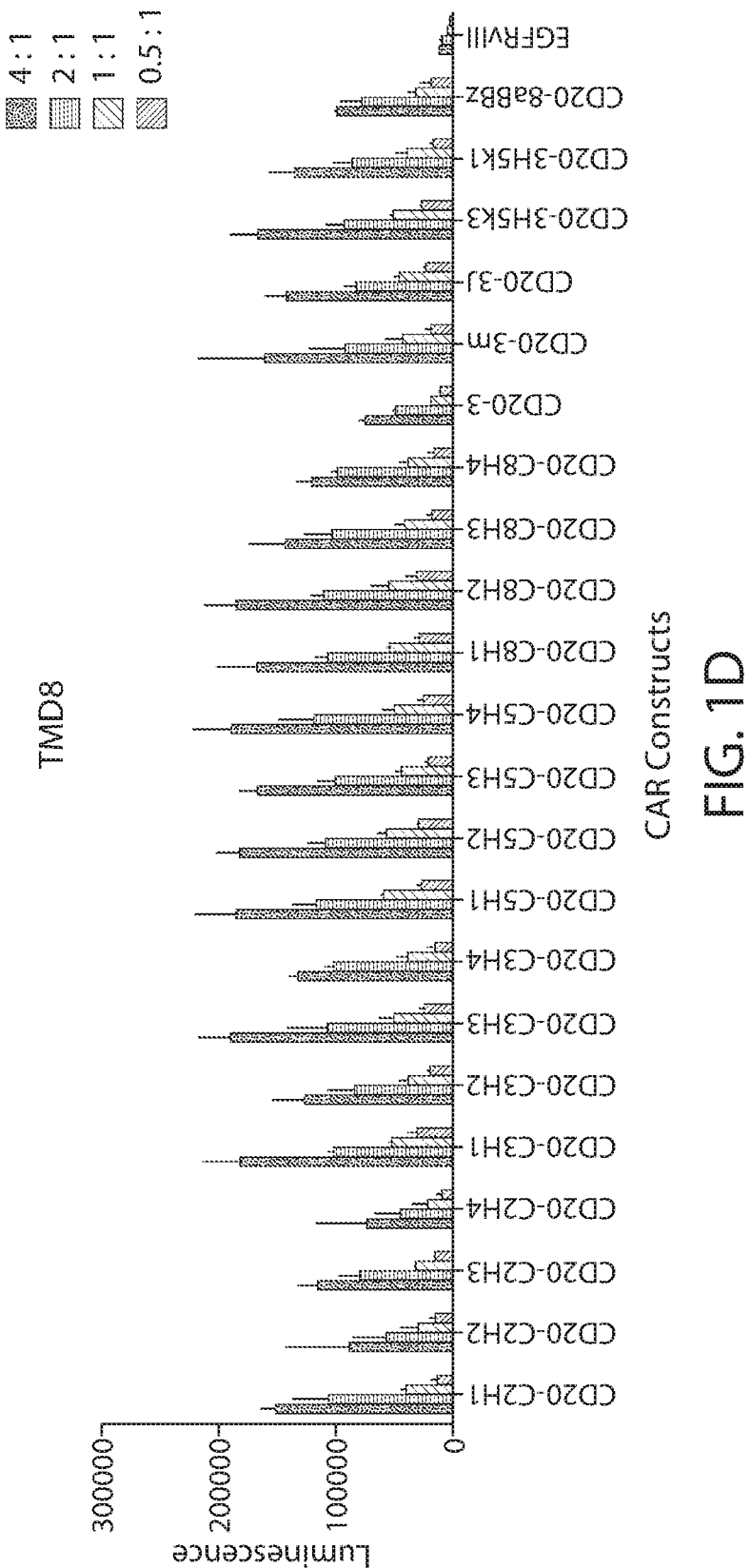
Figure 1E:
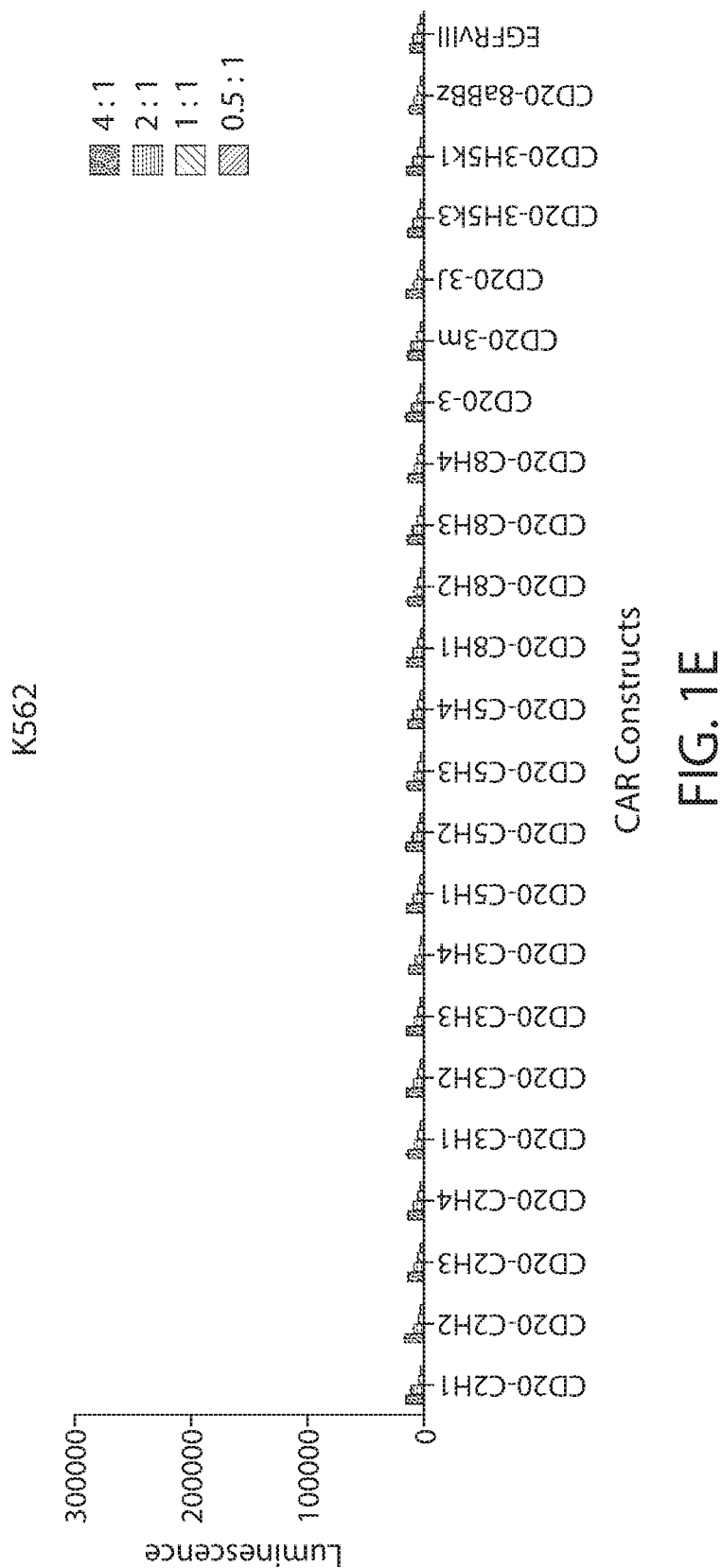

JNL CART cells were co-cultured with the Burkitt's lymphoma line Raji (RRID: CVCL_0511) and the diffuse large B cell lymphoma (DLBCL) lines Pfeiffer (RRID: CVCL_3326), HBL-1 (RRID: CVCL_4213) and TMD8 (RRID: CVCL_A442); K562 (RRID: CVCL_0004), a chronic myelogenous leukemia (CML) cell line, served as CD20-negative control. Co-cultures were set up in 384-well plates at effector-to-target (E:T) ratios of 4:1, 2:1, 1:1 and 0.5:1 and incubated for 24 h, after which the expression of luciferase by the activated JNL CAR T cells was quantified by britelite plus Reporter Gene Assay System (PerkinElmer, Waltham, Mass.). The amount of light emitted from each well (Luminescence) was a direct read-out of JNL activation by the respective CAR. All four CD20-positive target cell lines demonstrate activation of all humanized CD20 CARs (FIG. 1A-D). Humanization of the murine scFvs did not lead to loss in binding to CD20. Some of the humanized scFvs, which were fused to the transmembrane and signaling domains of the CARs, seem to have improved the efficacy of CARs to activate JNL T cells. These were CD20-C2H1, -C2H3, -C5H1, -C5H2, and -C8H3. None of the humanized mouse CARs showed activation by the CD20-negative line K562 (FIG. 1E).

Generation of CD20 CAR T Cells

Based on the results in the JNL reporter assay described above, the following CARs were chosen for analysis of efficacy in primary T cells: CD20-C2H1, -C2H3, -C3H2, -C3H3, -C5H1, -C5H2, and -C8H2. Additionally, CD20-Ofa and the controls CD20-8aBBz and CD20-3H5k3 were added. CD20 CAR T cells were generated by starting with blood from healthy apheresed donors whose naïve T cells were obtained by negative selection for T cells, CD4+ and CD8+ lymphocytes. These cells were activated by the addition of CD3/CD28 beads (DYNABEADS® Human T-Expander CD3/CD28, Thermo Fisher Scientific) at a ratio of 1:3 (T cell to bead) in T cell medium (RPMI-1640, 10% heat-inactivated fetal calf serum (FCS), 2 mM L-glutamine, 1× Penicillin/Streptomycin, 100 µM non-essential amino acids, 1 mM Sodium Pyruvate, 10 mM Hepes, and 55 µM 2-mercaptoethanol). T cells were cultured at $0.5 \times 10^6$ T cells in 1 mL medium per well of a 24-well plate at 37° C., 5% $CO_2$. After 24 hours, when T cells were blasting, 0.5 mL of non-concentrated, or smaller volumes of concentrated viral supernatant were added; T cells were transduced at a multiplicity of infection (MOI) of 5. T cells began to divide in a logarithmic growth pattern, which was monitored by measuring the cell counts per mL, and T cells were diluted in fresh medium every two days. T cells began to rest down after approximately 10 days; the combination of slowing growth rate and reduced T cell size (approaching 350 fL) determines the state for T cells to be cryopreserved for later analysis. All CD20 CAR T cells were produced in research grade (i.e., not clinical grade) manufacturing conditions.

Figure 2:
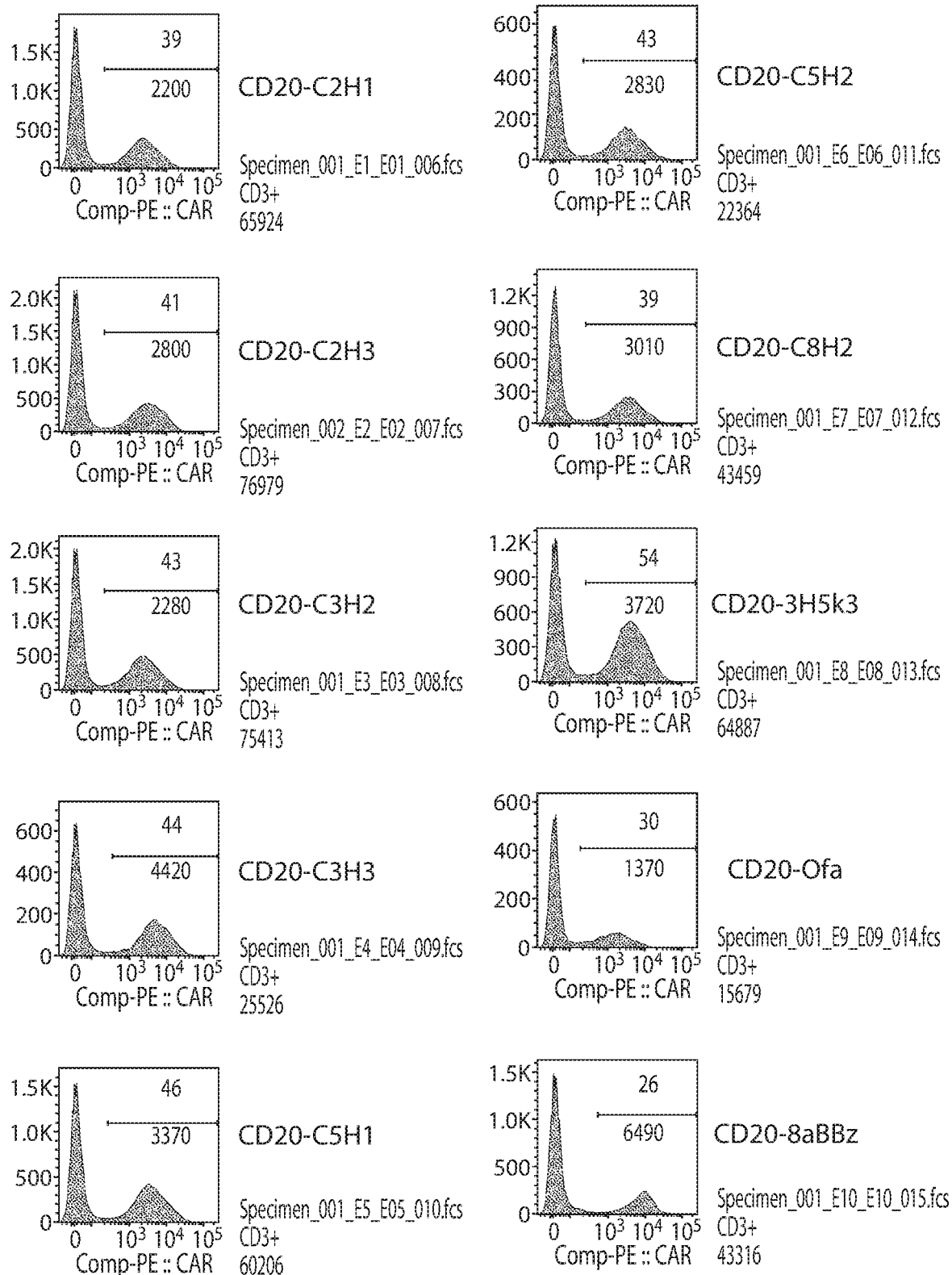
FIG. 2 is a graph showing expression level of CD20 CARs on primary human T cells. Cells were stained with soluble Biotinylated ProteinL (0.1 µg/well, GenScript, Piscataway, N.J.) and Streptavidin-PE (1:300, R-Phycoerythrin Streptavidin, Jackson ImmunoResearch, West Grove, Pa.) and assayed by flow cytometry. Top number in the graphs show the percentage of CAR+ cells, the number below describes the CAR expression level within that positive population (Geometric Mean).

Before cryopreserving, the percentage of cells transduced (expressing the CD20-specific CAR on the cell surface) was determined by flow cytometric analysis on a FACS Fortessa (BD). The viral transduction showed comparable expression levels, indicating similar transduction efficiency (percent cells transduced, FIG. 2) as well as surface expression of the respective CARs (mean fluorescence intensity, MFI); with the CD20-Ofa CAR showing lowest expression levels (MFI 1370 versus 2200 to 4420). The cell counts of the CAR T cell cultures indicated that there is no detectable negative effect of the human scFv bearing CAR-CD20 on the cells ability to expand normally when compared to the untransduced T cells ("UTD").

Evaluating Efficacy of CD20 CAR-Redirected T Cells.

To evaluate the functional abilities of CD20 CAR T cells, the cells, generated as described above, were thawed, counted and co-cultured with target cancer cells to read out their killing capabilities, secretion of cytokine as well as proliferation. In addition to the humanized scFv bearing CARs CD20-C2H1, -C2H3, -C3H2, -C3H3, -C5H1, -C5H2, and -C8H2 the CD20-Ofa CAR as well as the controls CD20-8aBBz and CD20-3H5k3 were used as controls. The EGFRvIII CAR and non-transduced T cells (UTD) were used as non-targeting T cells controls.

Figure 3A:
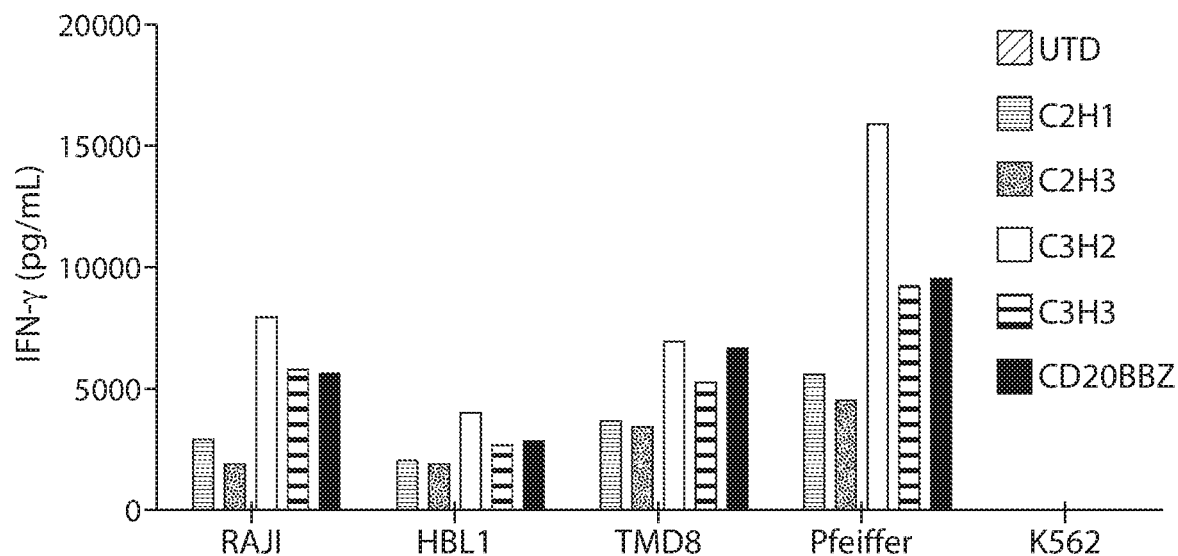
FIGS. 3A-3B are graphs showing how CD20 CAR T cells secrete IFN-γ in response to stimulation by CD20 expressing target cells. IFN-γ was measured in the media of co-cultures of CAR T cells with the Burkitt's lymphoma line Raji and the diffuse large B cell lymphoma (DLBCL) lines Pfeiffer, HBL-1 and TMD8; K562, a chronic myelogenous leukemia (CML) cell line, served as CD20-negative control. CARTs and target cells were co-cultured at an effector-to-target cell ratio of 1:1 for 24 h, after which supernatants were harvested and IFN-γ amounts were quantified. CARTs were assayed in two separate experiments (FIG. 3A and FIG. 3B, respectively).
Figure 3B:
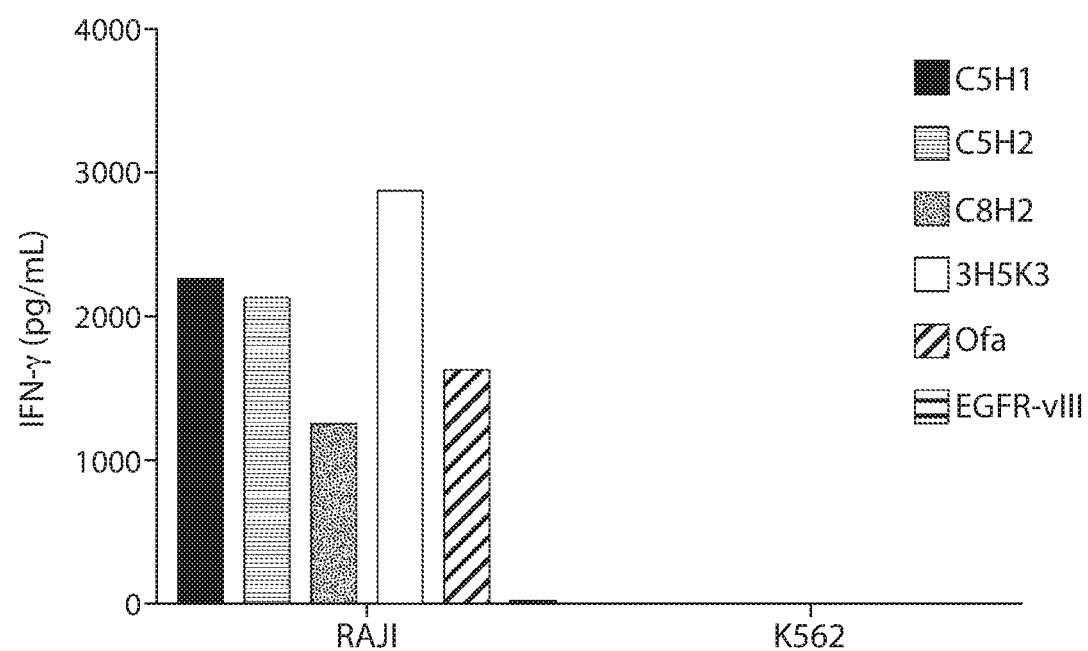

To measure cytokine production of CD20 CAR T cells in response to CD20-expressing target cells, CAR T cells were co-cultured with the Burkitt's lymphoma line Raji and the diffuse large B cell lymphoma (DLBCL) lines Pfeiffer, HBL-1 and TMD8; K562, a chronic myelogenous leukemia (CML) cell line, served as CD20-negative control. Cells were cultured at an effector:target ratio of 1:1 and 25,000 cells per well of a 96-well plate for 24 h, after which the media was removed for cytokine analysis using the V-PLEX Human IFN-γ Kit (Meso Scale Diagnostics, Rockville, Md.) for cytokine quantification. Data shows that most humanized mouse CD20 CARTs as well as the CD20-8aBBz, CD20-Ofa and CD20-3H5k3 CARTs produced IFN-γ when cultured with CD20-positive target cell lines Raji, Pfeiffer, HBL1 and TMD8 (FIGS. 3A and B). CD20-C3H2 and -C3H3 were the highest cytokine producers with levels similar or higher than CD20-8aBBz. Levels of cytokine produced by CD20 CARTs after exposure to the control K562 cells were non-detectable (FIGS. 3A and B), indicating no unspecific activation by CD20 CARs.

Conclusions

All humanized CD20-specific CARs tested here were expressed on the cell surface of primary human T cells similarly well. CD20-C2H1, -C2H3, -C3H2, -C3H3, -C5H1, -C5H2, and -C8H2 were expressed similarly to the controls CD20-8aBBz and CD20-3H5k; only CD20-Ofa showed lower levels of expression. In the JNL T cell reporter assay, all CD20 CAR T cells showed similar, CD20-specific reactivity. CD20-C3H2 and CD20-C3H3 showed slightly better or at least equal function as compared to CD20-8aBBz with regard to IFN-γ production by primary human T cells. Overall, the transfer of CD20 CARs induced anti-CD20 reactivity but no off-target function was detected as controlled with the CD20-negative cell line K562.

Example 4: Analysis and In Vitro Activity of Human Anti-CD22 scFv Bearing CARTs

Single chain variable fragments for anti-CD22 antibodies were cloned into lentiviral CAR expression vectors comprising the CD3zeta chain and the 4-1BB stimulatory molecules; CD22-57, CD22-58, CD22-59, CD22-60, CD22-61, CD22-62, CD22-63, CD22-64, and CD22-65 were compared to CD22-53. All the CD22 CARs are set forth in Table 6. The optimal constructs were selected based on the quantity and quality of the effector T cell responses of these CD22 CAR-transduced T cells ("CD22 CART" or "CD22 CAR T cells") in response to CD22 expressing ("CD22+") targets. Effector T cell responses include, but are not limited to, cellular expansion, proliferation, doubling, cytokine production and target cell killing or cytolytic activity (degranulation).

Generation of CD22 CAR T Cells

Human scFv encoding lentiviral transfer vectors were used to produce the genomic material packaged into the VSVg pseudotyped lentiviral particles. Lentiviral transfer vector DNA encoding the CAR was mixed with the three packaging components VSVg, gag/pol and rev in combination with lipofectamine reagent to transfect Lenti-X 293T cells (Clontech), followed by medium replacement 12-18 h later. 30 hours after medium change, the media is collected, filtered and stored at −80° C.

CD22 CAR T cells were generated by starting with blood from healthy apheresed donors whose nave T cells were obtained by negative selection for T cells, CD4+ and CD8+ lymphocytes. These cells were activated by the addition of CD3/CD28 beads (DYNABEADS® Human T-Expander CD3/CD28, Thermo Fisher Scientific) at a ratio of 1:3 (T cell to bead) in T cell medium (RPMI1640, 10% heat-inactivated fetal calf serum (FCS), 2 mM L-glutamine, 1× Penicillin/Streptomycin, 100 µM non-essential amino acids, 1 mM Sodium Pyruvate, 10 mM Hepes, and 55 µM 2-mercaptoethanol) at 37° C., 5% $CO_2$. T cells were cultured at $0.5 \times 10^6$ T cells in 1 mL medium per well of a 24-well plate. After 24 hours, when T cells were blasting, 0.5 mL of non-concentrated, or smaller volumes of concentrated viral supernatant were added; T cells were transduced at a multiplicity of infection (MOI) of 5. T cells began to divide in a logarithmic growth pattern, which is monitored by measuring the cell counts per mL, and T cells are diluted in fresh medium every two days. As the T cells began to rest down after approximately 10 days, the logarithmic growth wanes. The combination of slowing growth rate and reduced T cell size (approaching 350 fL) determines the state for T cells to be cryopreserved for later analysis. All CD22 CAR T cells were produced in research grade (i.e., not clinical grade) manufacturing conditions.

Figure 4:
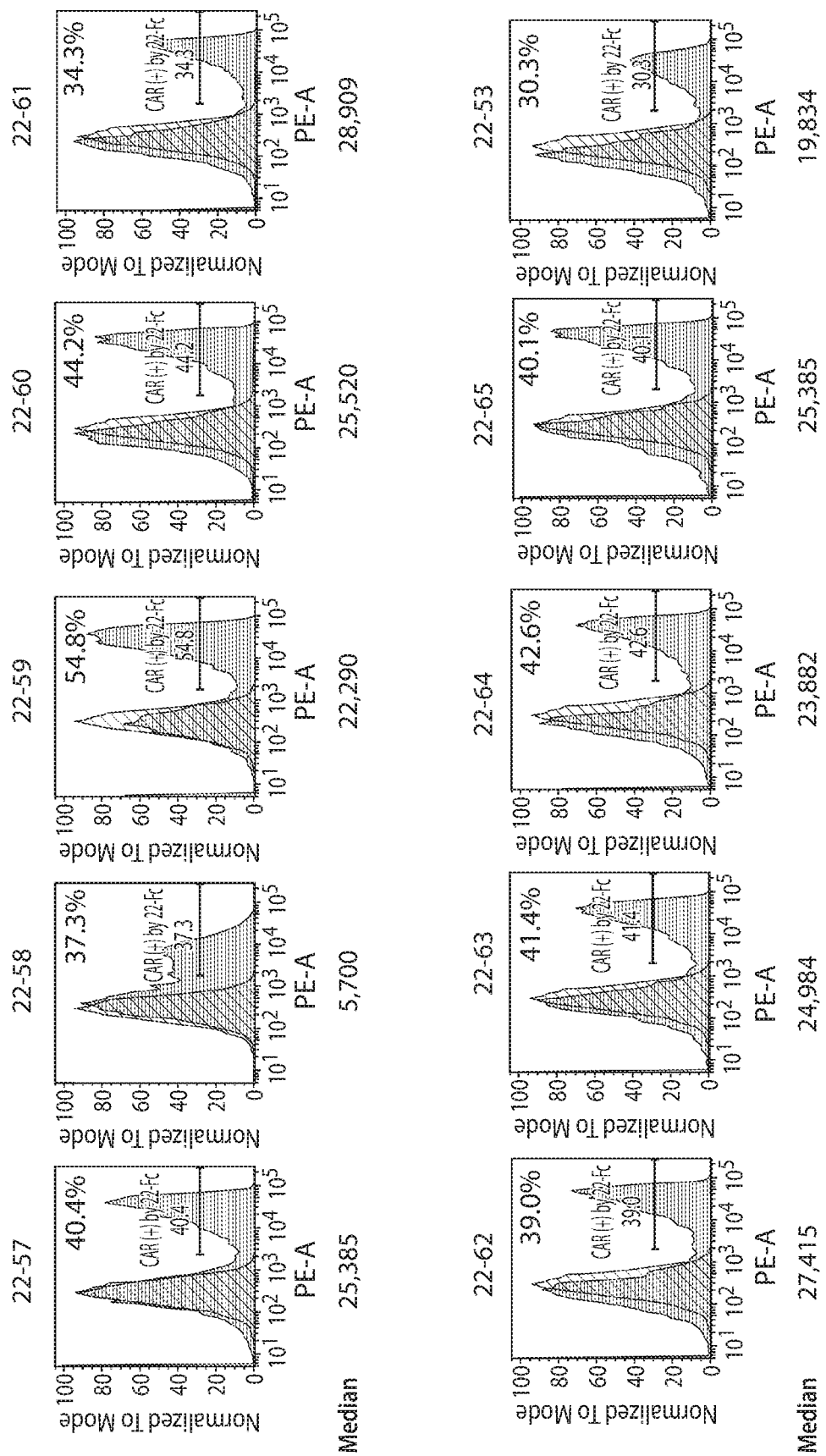
FIG. 4 is a graph showing expression level of CD22 CARs on primary human T cells. Cells were stained with soluble CD22-Fc (0.2 ug/well, R&D Systems, Minneapolis, Minn.) and anti-human Fc (1:300, R-Phycoerythrin AffiniPure F(ab')$_2$ Fragment Goat Anti-Human IgG, Fcγ Fragment Specific, Jackson ImmunoResearch, West Grove, Pa.) secondary antibody and assayed by flow cytometry. Number in the graphs show the percentage of CAR+ cells, the number below describes the CAR expression level within that positive population (Median).

Before cryopreserving, the percentage of cells transduced (expressing the CD22-specific CAR on the cell surface) were determined by flow cytometric analysis on a FACS Fortessa (BD). The viral transduction showed comparable expression levels, indicating similar transduction efficiency (percent cells transduced, FIG. 4) as well as surface expression of the respective CARs (mean fluorescence intensity, MFI). Only CD22-58 showed lower expression levels (MFI=5,700, compared to >20,000 for other CARs). The cell counts of the CAR T cell cultures indicate that there is no detectable negative effect of the human scFv bearing CAR-CD22 on the cells ability to expand normally when compared to the untransduced T cells ("UTD").

Evaluating Efficacy of CD22 CAR-Redirected T Cells.

To evaluate the functional abilities of CD22 CAR T cells, the cells, generated as described above, were thawed, counted and co-cultured with target cancer cells to read out their killing capabilities, secretion of cytokine as well as proliferation. In addition to the human scFv bearing CARs CD22-57, CD22-58, CD22-59, CD22-60, CD22-61, CD22-62, CD22-63, CD22-64, and CD22-65, the CAR CD22-53 was used as a control. The control CAR CD22-53 was used in all assays to compare assay variation and/or act as a control. The EGFRvIII CAR and non-transduced T cells (UTD) were used as non-targeting T cells controls.

Figure 5A:
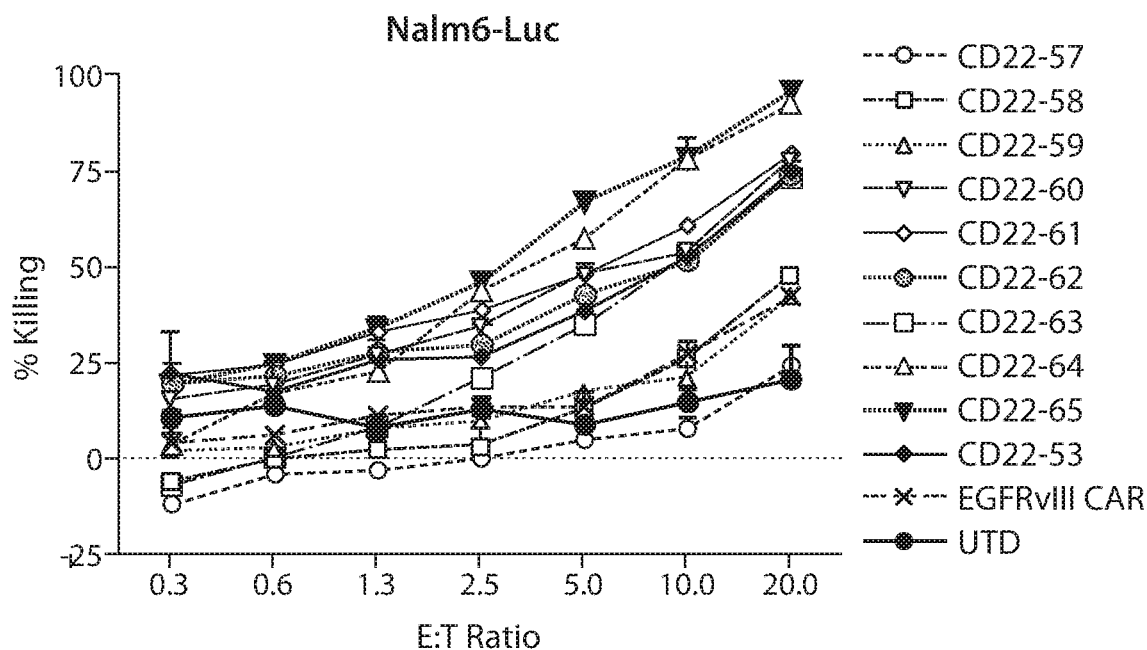
FIGS. 5A-5C are graphs showing that CD22 CAR T cells effectively kills CD22 expressing target cells. 20 h killing assay of CAR T cells with the acute lymphoblastic leukemia (ALL) lines Nalm6 (FIG. 5A) and SEM (FIG. 5B) as well as the CD22-negative CML line K562 (C). CARTs and target cells were co-cultured at different effector-to-target cell ratios (E:T) for 20 h, after which luciferase-expressing target cells were quantified using luminescence.
Figure 5B:
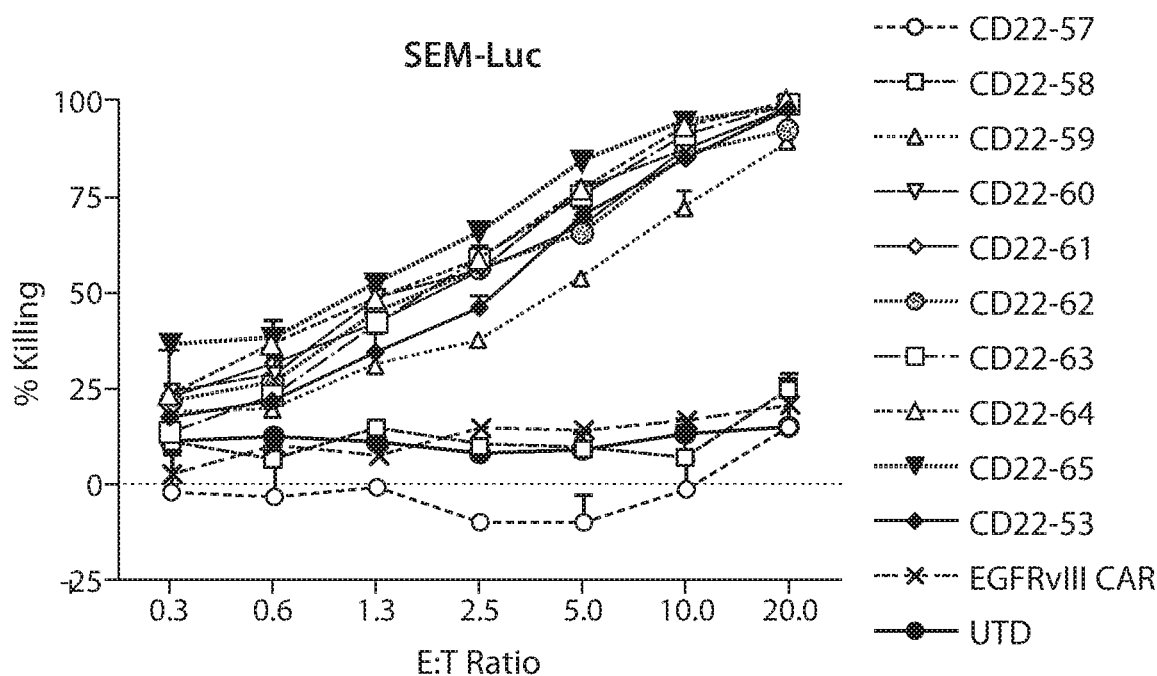
Figure 5C:
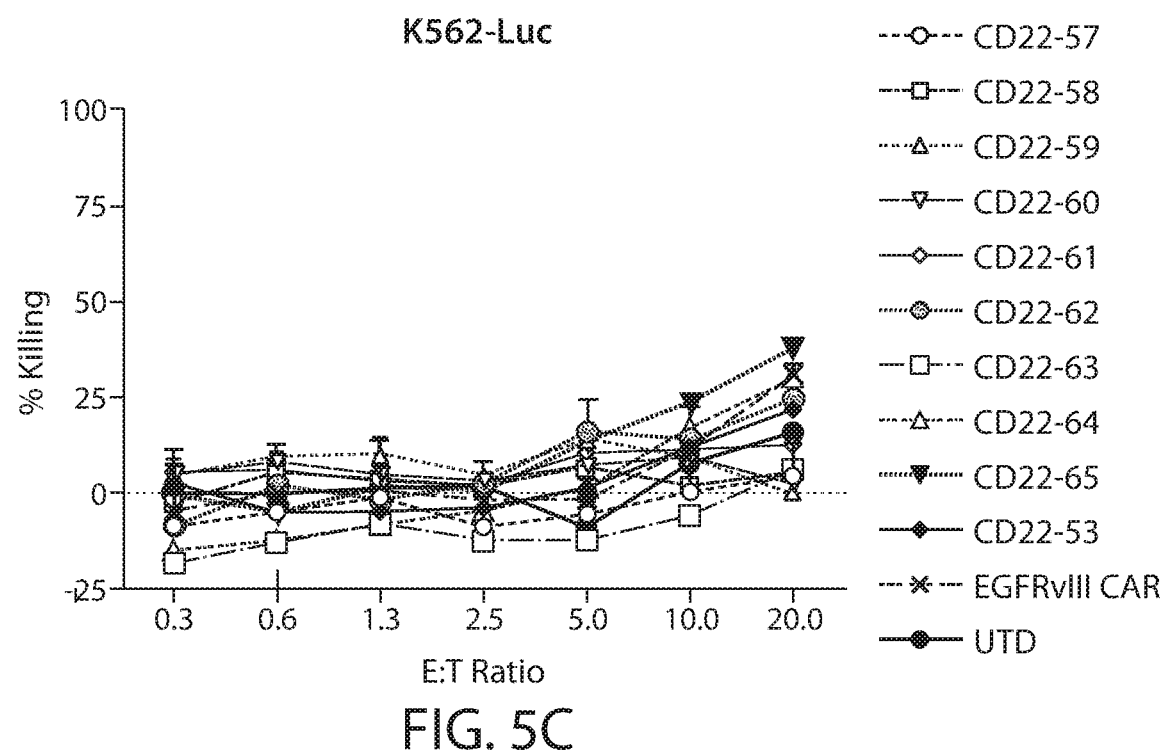

T cell killing was directed towards the acute lymphoblastic leukemia (ALL) lines Nalm6 (RRID: CVCL_0092) and SEM (RRID: CVCL_0095); K562 (RRID: CVCL_0004), a chronic myelogenous leukemia (CML) cell line served as CD22-negative control. All cell lines were transduced to express luciferase as a reporter for cell viability/killing. The cytolytic activities of CD22 CARTs were measured at a titration of effector:target cell ratios (E:T) of 20:1, 10:1, 5:1, 2.5:1, 1.25:1 0.63:1 and 0.31:1. Assays were initiated by mixing the respective number of T cells with a constant number of targets cells (25,000 cells per well of a 96-well plate). After 20 hours, remaining cells in the wells were lysed by addition of Bright-Glo™ Luciferase Assay System (Promega Corp., Madison, Wis.) reagent, to quantify the remaining cells in each well. "% Killing" was calculated in relation to wells containing target cells alone. The data show that transduction with the CD22 CART encoding lentiviruses transfers anti-CD22 killing activity to T cells (Nalm6 (FIG. 5A) and SEM (FIG. 5B)). UTD and EGFRvIII CAR-expressing T cells show background killing only. Similarly, none of the CD22 CARs show killing of the CD22-negative control line K562 (FIG. 5C). CD22-64 and CD22-65 showed highest killing of both Nalm6 and SEM target cell lines.

Figure 6A:
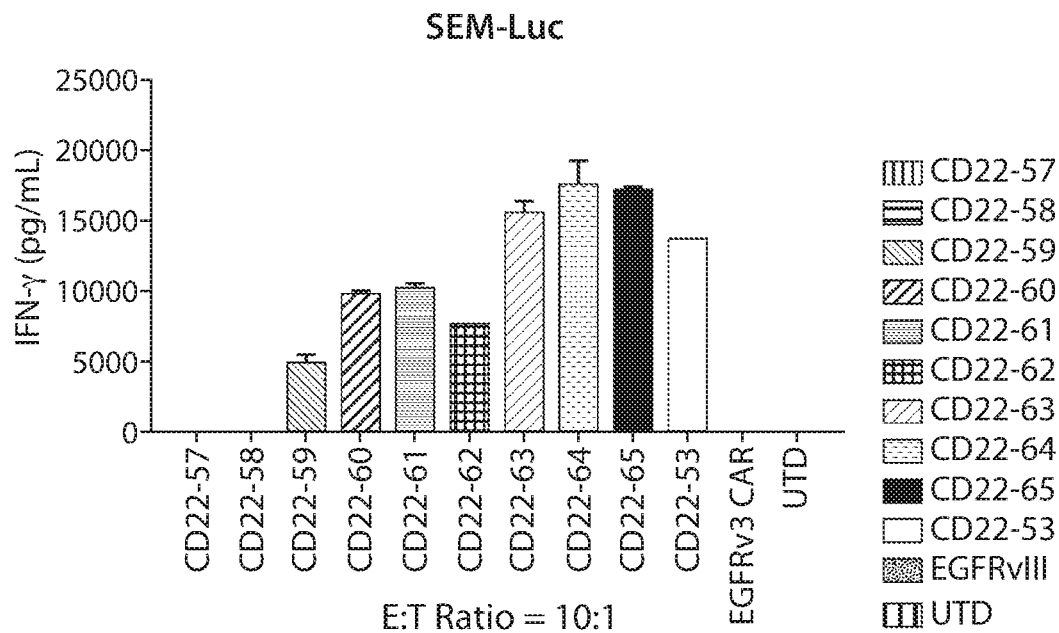
FIGS. 6A-6B are graphs showing that CD22 CAR T cells secrete IFN-γ in response to stimulation by CD22 expressing target cells. IFN-γ was measured in the media of co-cultures of CAR T cells with the ALL line SEM (FIG. 6A) as well as the CD22-negative CML line K562 (FIG. 6B). CARTs and target cells were co-cultured at an effector-to-target cell ratio of 1:1 for 24 h, after which supernatants were harvested and IFN-γ amounts were quantified.
Figure 6B:
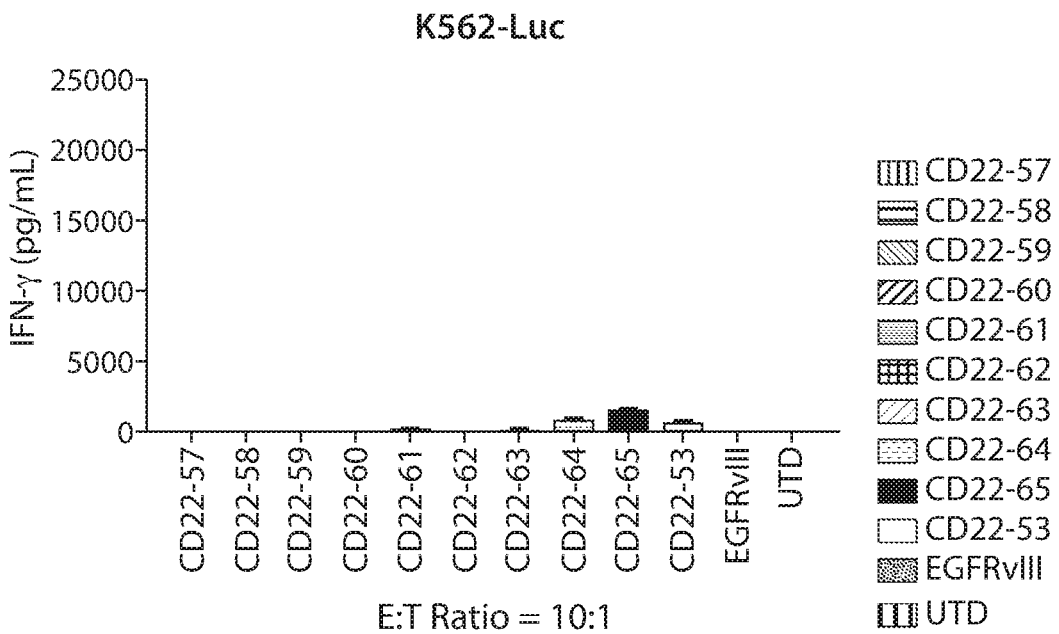

To measure cytokine production of CD22 CAR T cells in response to CD22-expressing target cells, CAR T cells were co-cultured with the ALL line SEM; K562, a CML line, served as CD22-negative control. Cells were cultured at an effector:target ratio of 1:1 and 25,000 cells per well of a 96-well plate for 24 h, after which the media was removed for cytokine analysis using the V-PLEX Human IFN-γ Kit (Meso Scale Diagnostics, Rockville, Md.) for cytokine quantification. Data shows that most new CD22 CARTs as well as the CD22-53 CARTs produced IFN-γ when cultured SEM (FIG. 6A). CD22-63, -64 and -65 were the highest cytokine producers. Levels of cytokine produced by CD22 CARTs after exposure to the control K562 cells were low (FIG. 6B), indicating no unspecific effects by CD22 CARs.

Figure 7A:
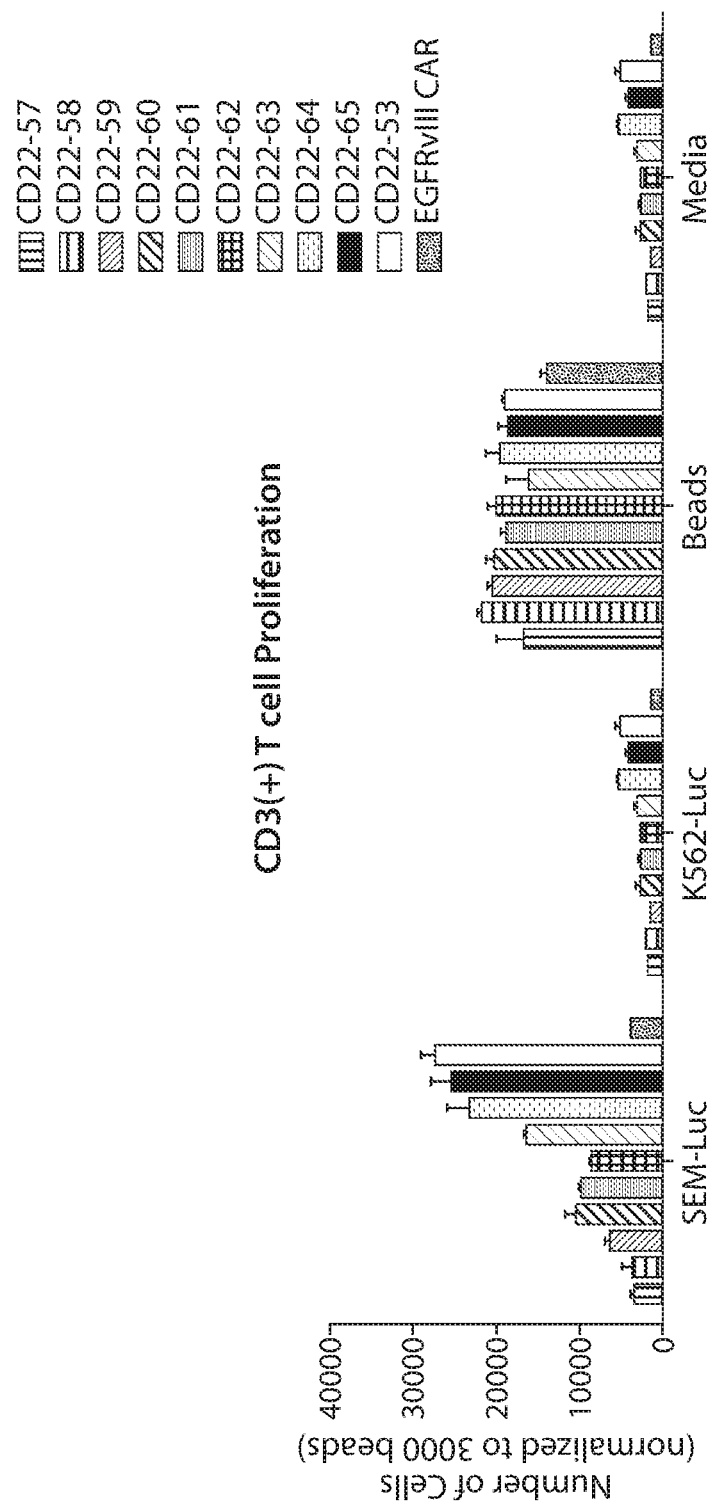
FIGS. 7A-7B are graphs showing that CD22 CAR T cells proliferate in response to stimulation by CD22 expressing target cells. CAR T cells were co-cultured with the ALL line SEM as well as the CD22-negative CML line K562 at an effector-to-target cell ratio of 1:1 for 4 days. CARTs were then stained with anti-CD3 antibody and soluble CD22-Fc to detect CAR expression, followed by a quantitative analysis using counting beads by flow cytometry.
Figure 7B:
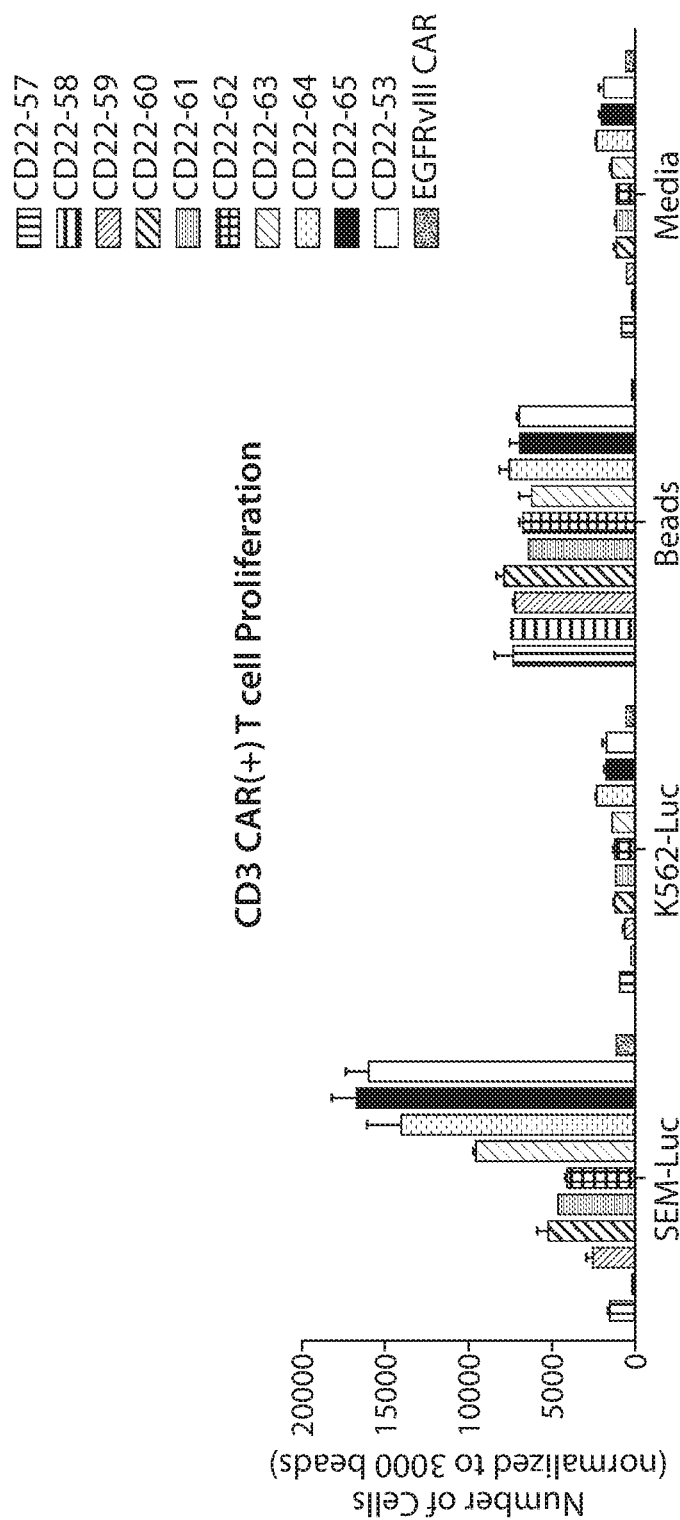

In the last T cell efficacy assay, the proliferative capacity of the CD22 CAR T cells was assessed. Again, thawed CAR T cells we co-cultured with the ALL line SEM, while K562, a CML line, served as CD22-negative control. Target cell lines were irradiated prior to co-culture to prevent overgrowth of the wells, they were then cultured at an effector:target ratio of 1:1 and 30,000 cells per well of a 96-well plate for 4 days. Additional controls were CD3/CD28 beads (positive control, DYNABEADS® Human T-Expander CD3/CD28, Thermo Fisher Scientific) as well as medium alone (negative control). Cells were stained on day 4 with anti-CD3 antibody as well as soluble CD22-Fc to detect CAR expression. Prior to acquisition on the BD Fortessa, 20 µl of CountBright™ Absolute Counting Beads (Thermo Fisher Scientific) were added to each sample for quantitative analysis of cell numbers. FIG. 7A shows the number of CD3+ T cells per 3000 counting beads, while FIG. 7B shows the number of CD3+ CAR+ CARTs per 3000 counting beads, as determined by binding of CD22-Fc. The data shows strongest CD22-induced proliferation of CD22-64, -65 as well as the control CD22-53 CAR T cells, followed by CD22-63. None of the CARTs showed proliferation in response to the CD22-negative line K562 nor due to any cell intrinsic stimulation of the CARs e.g. by aggregation.

Conclusions

Most CD22-specific CARs were expressed on the cell surface of primary human T cells similarly well: CD22-57, CD22-59, CD22-60, CD22-61, CD22-62, CD22-63, CD22-64, and CD22-65 were comparable to reference CARs CD22-53; only CD22-58 showed lower levels of expression. In T cell functional assays, CD22-57 and -58 were the least functional CARs, while CD22-64 and -65 were equally (IFN-γ production and proliferation) or more functional (killing) as compared to CD22-53. Overall, the transfer of CD22 CARs induced anti-CD22 reactivity but no off-target function was detected.

Example 5: CD22 CART in ALL

Anti-tumor activity of a set of CD22 CAR T cells was assessed in vivo in a NALM6 xenograft model. CAR T cells with CAR constructs CD22-60, CD22-63, and CD22-65 were evaluated versus positive control (CD22-53 and CD19) and mock CAR T cells (EGFRvIII).

Materials and Methods

Cell Line:

NALM6 (RRID: CVCL_0092) is a human leukemia cell line that was derived from the peripheral blood of a 19-year-old man with acute lymphoblastic leukemia (ALL) in relapse in 1976. Cells were grown in RMPI medium containing 10% fetal bovine serum. This cell line grows in suspension in tissue culture flasks. This cell line persists and expands in mice when implanted intravenously. The NALM6 cells have been modified to express luciferase, so that that tumor cell growth can also be monitored by imaging the mice.

Mice:

6 week old NSG (NOD.Cg-Prkdc$^{scid}$Il2rg$^{tm1Wjl}$/SzJ) mice were received from the Jackson Laboratory (stock number 005557). Animals were allowed to acclimate in the Novartis NIBR animal facility for at least 3 days prior to experimentation. Animals were handled in accordance with Novartis ACUC regulations and guidelines. Electronic transponders for animal identification were implanted on the left flank one day prior to tumor implantation.

Tumor Implantation:

NALM6 cells in logarithmic growth phase were harvested and washed in 50 ml falcon tubes at 1200 rpm for 5 minutes, once in growth media and then two times in cold sterile PBS. The cells were resuspended in PBS at a concentration of $5 \times 10^6$ per ml, placed on ice, and immediately injected in mice. Cancer cells were injected intravenously in 200 µl through the caudal vein. The NALM6 model endogenously expresses CD22 and thus, can be used to test the in vivo efficacy of CD22-directed CAR T cells. This model grows well when implanted intravenously in mice and can be imaged for tumor burden measurements. Upon injection of $1 \times 10^6$ cancer cells in PBS, the tumors establish and can be accurately measured within 3 days. Baseline measurements are $4\text{-}6 \times 10^{\wedge}5$ photons/second (p/s). Within 7 days the mean bioluminescence measurement is $2\text{-}4 \times 10^{\wedge}6$ p/s and untreated tumors reach endpoint measurement ($2\text{-}3 \times 10^{\wedge}9$) by 21-26 days. Anti-tumor activities of therapeutic agents are often tested once tumors are fully engrafted. Thus, there is a large window with this model during which the anti-tumor activity of the CAR T cells can be observed.

CAR T Cell Dosing:

Mice were dosed with $5 \times 10^6$ CAR T cells ($12.3 \times 10^6$ total T cells) 7 days after tumor implantation. Cells were partially thawed in a 37° C. water bath and then completely thawed by the addition of 1 ml of warmed growth media to the tube containing the cells. The thawed cells were transferred to a 50 ml falcon tube and adjusted to a final volume of 12 ml with growth media. The cells were washed twice and spun at 300 g for 10 minutes and then counted by hemocytometer. T cells were then resuspended at a concentration of $61.7 \times 10^6$ cells per ml in cold PBS and kept on ice until the mice were dosed. The mice were injected intravenously via the tail vein with 200 μl of the T cells for a dose of 5×10⁶ CAR T cells (12.3×10⁶ total T cells) per mouse. 5 mice per group were either treated with 200 μl of PBS alone (PBS), T cells transduced with a mock EGFRvIII CAR, CD19 CAR T cells, CD22-53 CAR T cells, as well as the novel CD22-60, CD22-63, or CD22-65 CAR T cells. All cells were prepared from the same donor in parallel.

Animal Monitoring:

The health status of the mice was monitored daily, including twice weekly body weight measurements. The percent change in body weight was calculated as $(BW_{current}-BW_{initial})/(BW_{initial})\times100\%$. Tumors were monitored 2 times weekly by imaging the mice.

Results

The anti-tumor activity of CD22 CAR T cells was assessed in a B-cell acute lymphoblastic leukemia xenograft model (Luo et al., Cancer Research 1989). Following tumor cell implantation on day 0, tumor bearing mice were randomized into treatment groups and were administered 5×10⁶ CAR T cells (12.3×10⁶ total T cells) intravenously via the lateral tail vein on day 7 after tumor implantation. Tumor growth and animal health were monitored until animals achieved endpoint. The mice which received PBS or the mock EGFRvIII CAR T cells were euthanized on days 23 and 30, respectively, when tumors were causing decreased hind leg mobility. All other groups were euthanized on day 43.

Figure 8:
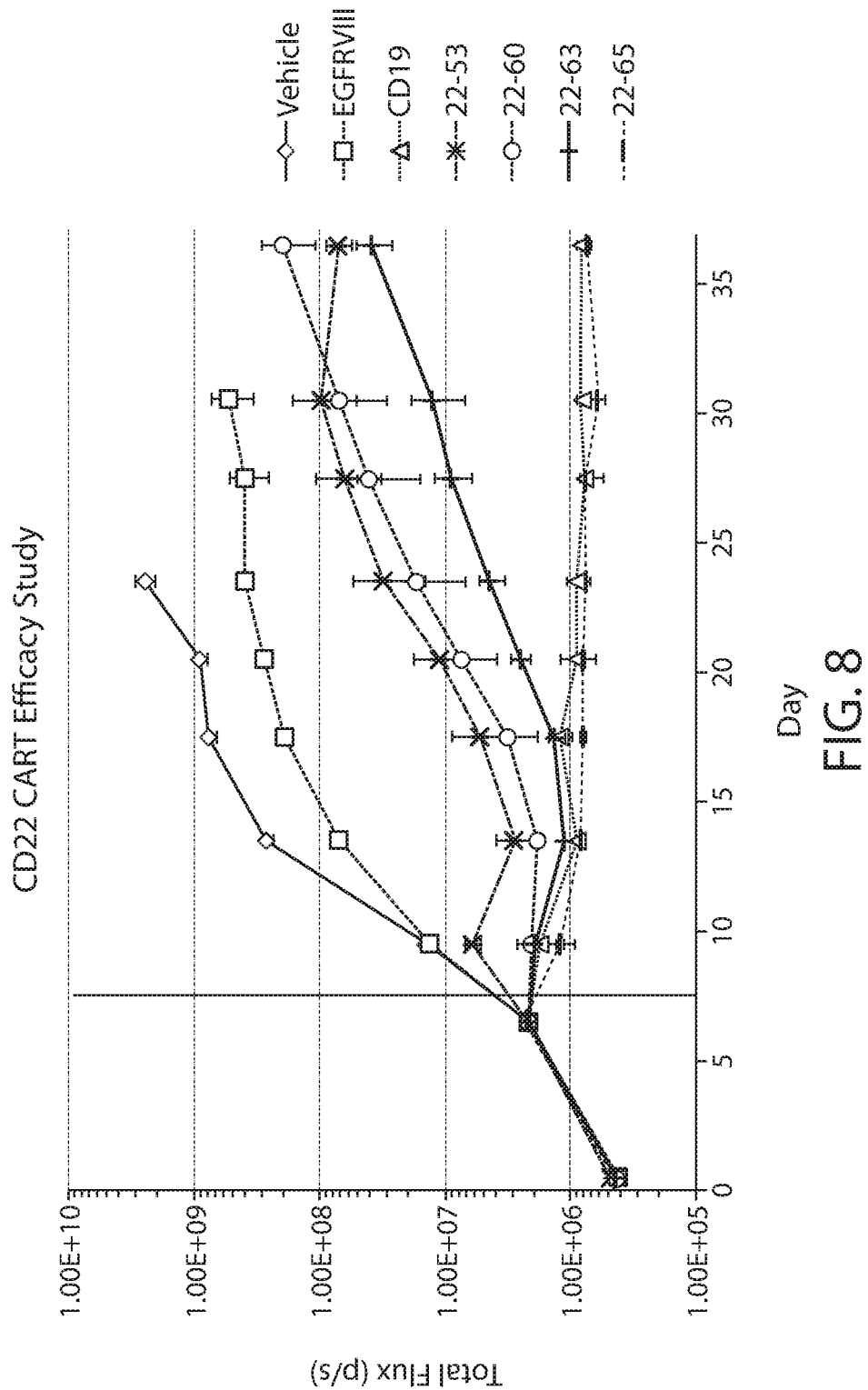
FIG. 8 are graphs showing the mean bioluminescence plots of the CD22 CAR T cells tested in the ALL model according to Example 5.

The mean bioluminescence for all treatment groups is plotted in FIG. 8. The PBS treatment group, which did not receive any T cells, demonstrates baseline NALM6 tumor growth kinetics in intravenously injected NSG mice. The EGFRvIII treatment group received T cells transduced with a control CAR. These cells serve as a T cell control to show the non-specific response of human donor T cells in this model. Both the PBS and the mock treatment groups demonstrated continuous tumor progression throughout this study. The EGFRvIII group shows a slight slower tumor growth, due to the background activity of the donor T cells. CD22-60, CD22-63, as well as CD22-53 all show significantly slower tumor growth when compared to EGFRvIII. CD22-65 shows tumor regression and is comparable to the positive control CD19.

Discussion

This study demonstrated that the CD22-specific CAR T cells CD22-65 are capable of leading to the regression of NALM6 tumors. While the other constructs showed a slowing of tumor growth, none were as complete or as durable as the effects of CD22-65.

Figure 9A:
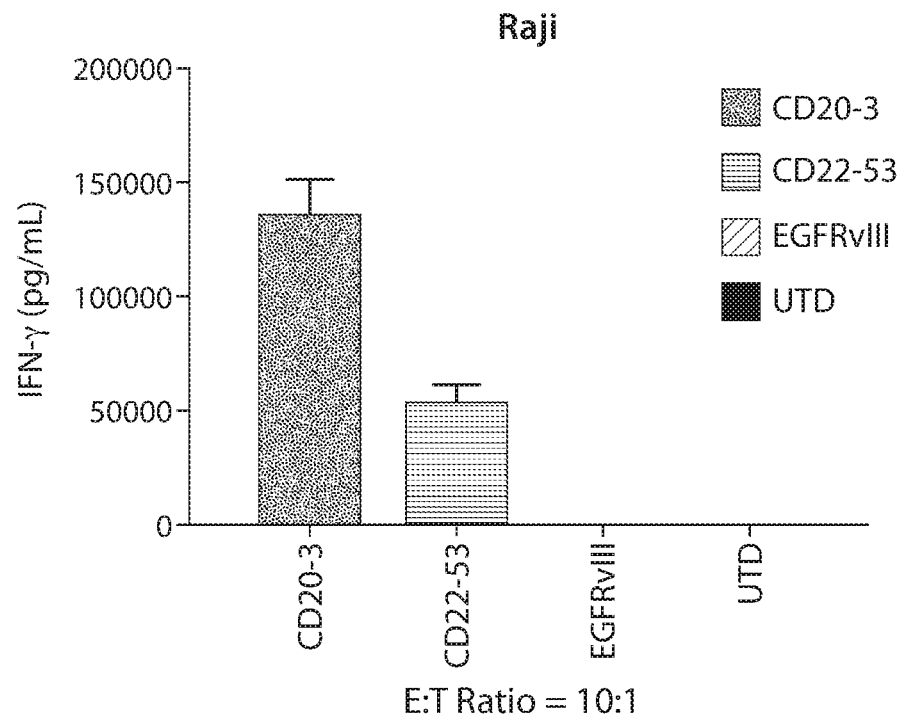
FIGS. 9A-9C are graphs showing how CD20-3 CAR T cells and CD22-53 T cells secrete IFN-γ in response to stimulation, according to Example 6. IFN-γ was measured in the media of co-cultures of CAR T cells with the Burkitt's lymphoma line Raji (FIG. 9A), the diffuse large B cell lymphoma (DLBCL) line Pfeiffer (FIG. 9B), the ALL line SEM (FIG. 9C).
Figure 9B:
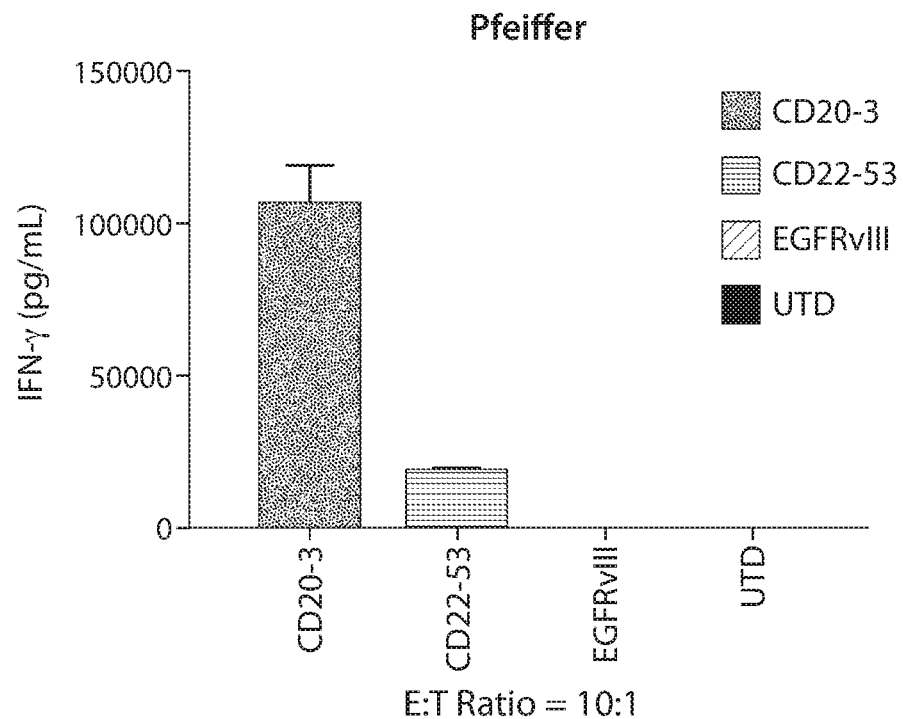
Figure 9C:
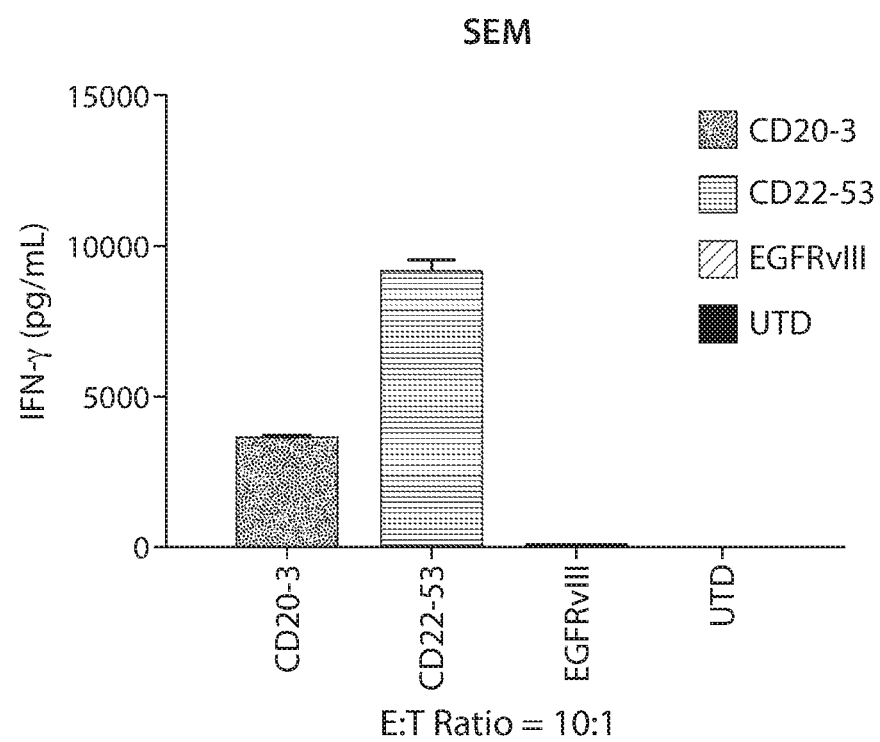

Example 6: Comparative Analysis of In Vitro Activity of Anti-CD20 and Anti-CD22 scFv Bearing Carts To compare the activity of CD22 or CD20 targeting CAR T cells in vitro, the control CAR T cells CD20-3 and CD22-53 were generated as described in Examples 3 and 4, respectively. Co-cultures of CAR T cells and cancer cell lines were conducted as described in Examples 3 and 4. Activation of CAR T cells was measured by means of IFN-γ secretion (FIG. 9). Interestingly, the CD20-3 CAR lead to more cytokine secretion when cultured with the Burkitt's lymphoma line Raji (FIG. 9A) and the DLBCL line Pfeiffer (FIG. 9B), as compared to the CD22-53 CAR T cells. Inversely, the ALL line SEM stimulated CD22-53 to a greater extend as compared to CD20-3, albeit at an overall lower level (FIG. 9C).

This comparison demonstrated the general response of both CD20 and CD22 CARs to B cell malignancies in general. The bias in CAR T activation correlated with the levels of CD20 and CD22 expression on the respective target cell lines.

Example 7: In Vivo Activity of CARTs Bearing Humanized Anti-CD20 scFvs

Anti-tumor activity of a set of CD20 CAR T cells was assessed in vivo in a TMD8 xenograft model. CAR T cells with CAR constructs CD20-C3H2, CD20-C5H1, CD20-3H5k3, CD20-Ofa, and CD20-8aBBZ were evaluated. CD20-C3H2, CD20-C5H1, CD20-3H5k3 CARs are based on humanized mouse (C3H2 and C5H1) and rat (3H5k3) CD20-specific scFvs. CD20-8aBBZ is based on a published CD20-targeting CAR (Jensen et al., Mol. Ther., 2000, incorporated herein by reference).

Cell Lines:

TMD8 (RRID: CVCL_A442) is a human diffuse large B-cell lymphoma (DLBCL) cell line of the activated B-cell (ABC) subtype. Cells were grown grow in suspension in MEM medium containing 10% fetal bovine serum, 1×HEPES, Pen/Strep, L-Glut, and NEAA. TMD8 persist and grows in mice when implanted sub-cutaneously (s.c.).

Mice:

6 week old NSG (NOD.Cg-Prkdc$^{scid}$Il2rg$^{tm1Wjl}$/SzJ) mice were received from the Jackson Laboratory (stock number 005557). Animals were allowed to acclimate in the Novartis NIBR animal facility for at least 3 days prior to experimentation. Animals were handled in accordance with Novartis ACUC regulations and guidelines. Electronic transponders for animal identification were implanted on the left flank one day prior to tumor implantation.

Tumor Implantation:

Cells in logarithmic growth phase were harvested and washed in 50 ml falcon tubes at 1200 rpm for 5 minutes, once in growth media and then twice in cold sterile PBS. Cells were resuspended in PBS at a concentration of 25×10⁶ per ml, placed on ice, and injected in mice. Cancer cells were injected s.c. in 200 μl. The TMD8 model endogenously expresses CD20 and thus, can be used to test the efficacy of CD20-directed CAR T cells in vivo. This model grows well when implanted s.c. in mice, which can be measured by caliper measurements. Upon injection of 5×10⁶ cancer cells, the tumors establish and can be accurately measured within 3-4 days. Tumor volumes were determined by caliper measurement (2-3 times per week) and calculated as follows:

$$\text{TumorVolume}=(\max(\text{tumor}X,\text{tumor}Y)*\{\min(\text{tumor}X,\text{tumor}Y)\}^{2}*\pi)/6$$

Within 9 days the tumor volume measurement was 200 mm³ and untreated tumors reach endpoint measurement (>1200 mm³) by 15-18 days. Anti-tumor activities of therapeutic agents are often tested once tumors are fully engrafted. Thus, there is a suitable window with this model during which the anti-tumor activity of CAR T cells can be observed.

CAR T Cell Dosing:

Mice were dosed 9 days after tumor implantation, with 3×10⁶ CAR T cells. Cells were partially thawed in a 37° C. water bath and then completely thawed by the addition of 1 ml of warmed growth media. The thawed cells were transferred to a 50 ml falcon tube and adjusted to a final volume of 12 ml with growth media. The cells were washed twice and spun at 300 g for 10 minutes and then counted by hemocytometer. T cells were then resuspended at respective concentrations in cold PBS and kept on ice until the mice were dosed. The CARTs were injected intravenously via the tail vein in 200 al, for a dose of $3\times10^6$ CAR T cells. 5 mice per group were either treated with 200 µl of PBS alone (PBS), EGFRvIII-specific, mock CAR T cells as well as CD20-C3H2, CD20-C5H1, CD20-3H5k3, CD20-Ofa, and CD20-8aBBZ. All cells were prepared from the same donor in parallel.

Animal Monitoring:

The health status of the mice was monitored daily, including twice weekly body weight measurements. The percent change in body weight was calculated as (BWcurrent–BWinitial)/(BWinitial)×100%.

Figure 11:
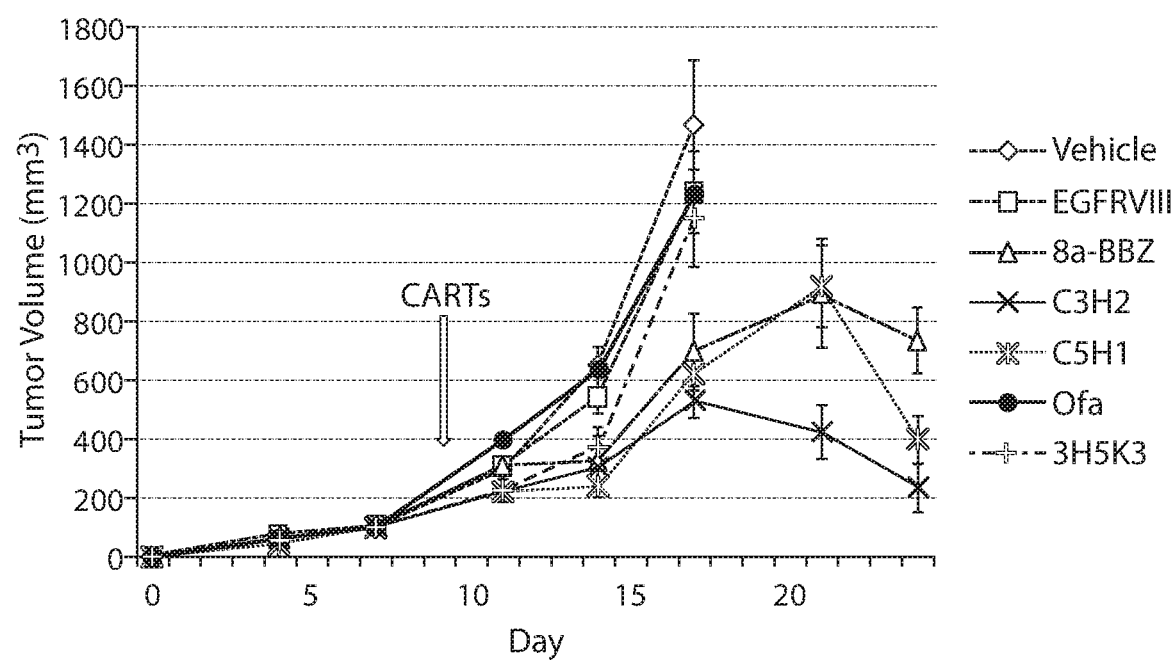
FIG. 11 is a graph showing the mean tumor volume (mm$^3$) for NSG mice treated with T cells expressing the mock EGFRvIII CAR, CD20-8aBBZ CAR, CD20-C3H2 CAR, CD20-C5H1 CAR, CD20-Ofa CAR, and CD20-3H5k3 CAR or with vehicle (PBS).

The anti-tumor activity of CD20 CAR T cells was assessed in a DLBCL leukemia xenograft model (FIG. 11). Following tumor cell implantation, tumor bearing mice were randomized into treatment groups and CAR T cells were administered intravenously via the lateral tail vein on day 9 after tumor implantation. Tumor growth and animal health were monitored until animals achieved endpoint. Mice in the negative control groups, which received PBS or the mock EGFRvIII-specific CAR T cells were euthanized on day 17. Also the groups which received CD20-Ofa and CD20-3H5k3 showed no efficacy of the respective CARTs and were euthanized on day 17. The other groups were euthanized on day 24.

The PBS treatment group, which did not receive any T cells, demonstrates baseline TMD8 tumor growth kinetics. The EGFRvIII treatment group received mock CAR-transduced T cells and served as a T cell control to show the non-specific response of human donor T cells in this model. Both the PBS and EGFRvIII treatment groups demonstrated continuous tumor progression throughout this study. CD20-Ofa and CD20-3H5k3 showed similar growth kinetics, suggesting no anti-tumor efficacy by these CARTs. CD20-C3H2, CD20-C5H1, and the control CD20-8aBBZ CAR T cells all showed significantly slower tumor growth, with the strongest and fastest regression seen for CD20-C3H2, followed by CD22-C5H1.

This study demonstrated that the CD20-specific CAR T cells CD22-C3H2 and CD22-C5H1 are capable of leading to the regression of TMD8 tumors. The efficacy was superior to CD20-8aBBZ, the published benchmark CAR.

Example 8: In Vitro Activity of CARTs Bearing Human Anti-CD22 scFv with Short Linkers Genes encoding for single chain variable fragments for anti-CD22 antibodies (CD22-65, CD22-65s, positive control CD22 CAR m971 (m971), and m971s) were cloned into lentiviral CAR expression vectors with the CD3zeta chain and 4-1BB stimulatory molecules: The CD3zeta chain was either wildtype (Zwt) or carried a Q65K mutation (Zmut). The constructs were ranked based on the effector T cell responses of these CD22 CAR-transduced T cells ("CD22 CART" or "CD22 CAR T cells") in response to CD22 expressing ("CD22+") targets. Effector T cell responses include, but are not limited to, cellular expansion, proliferation, doubling, cytokine production and target cell killing or cytolytic activity (degranulation).

Generation of CD22 CAR T Cells:

Human scFv encoding lentiviral transfer vectors were used to produce the genomic material packaged into the VSVg pseudotyped lentiviral particles. Lentiviral transfer vector DNA encoding the CAR was mixed with the three packaging components VSVg, gag/pol and rev in combination with lipofectamine reagent to transfect Lenti-X 293T cells (Clontech), followed by medium replacement 12-18 h later. 30 hours after medium change, the media is collected, filtered and stored at −80° C.

CD22 CAR T cells were generated by starting with blood from healthy apheresed donors whose T cells were enriched by negative selection of T cells, CD4+ and CD8+ lymphocytes (Pan T cell isolation, Miltenyi). T cells were activated by the addition of CD3/CD28 beads (DYNABEADS® Human T-Expander CD3/CD28, ThermoFisher Scientific) at a ratio of 1:3 (T cell to bead) in T cell medium (RPMI1640, 10% heat-inactivated fetal calf serum (FCS), 2 mM L-glutamine, 1x Penicillin/Streptomycin, 100 µM non-essential amino acids, 1 mM Sodium Pyruvate, 10 mM Hepes, and 55 µM 2-mercaptoethanol) at 37° C., 5% CO2. T cells were cultured at $0.5\times10^6$ T cells in 1 mL medium per well of a 24-well plate. After 24 hours, when T cells were blasting, non-concentrated or concentrated viral supernatant was added; T cells were transduced at a multiplicity of infection (MOI) of 5. T cells began to proliferate, which is monitored by measuring the cell concentration (as counts per mL), and T cells are diluted in fresh T cell medium every two days. As the T cells began to rest down after approximately 10 days, the logarithmic growth wanes. The combination of slowing growth rate and reduced T cell size (approaching 350 fL) determines the state for T cells to be cryopreserved for later analysis. All CD22 CAR T cells were produced under research grade (i.e., not clinical grade) manufacturing conditions.

Figure 12:
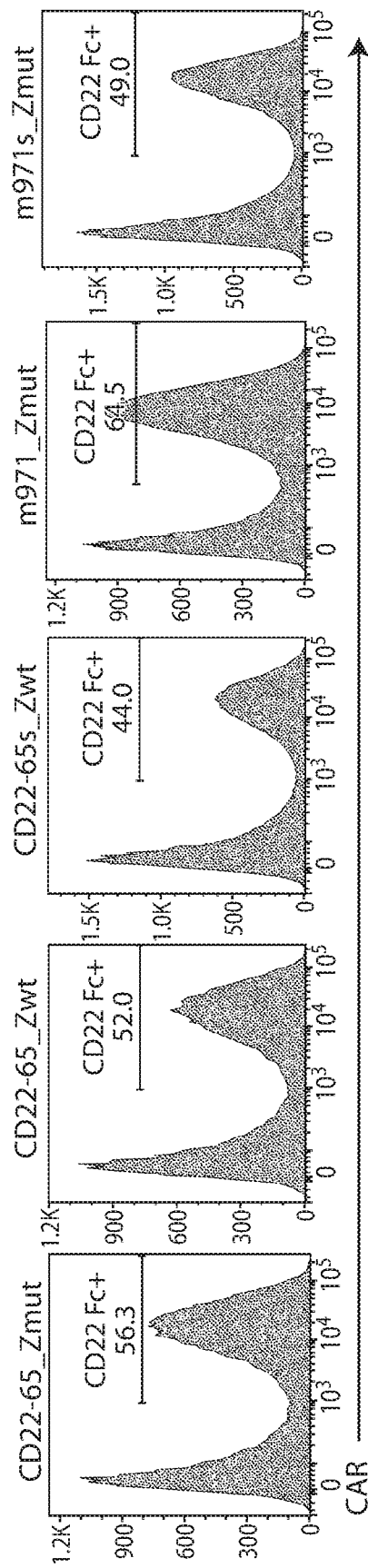
FIG. 12 is a graph showing the expression level of the CD22 65 CAR with a CD3zeta chain including a Q65K mutation (CD22-65_Zmut), the CD22-65 wild type CAR (CD22-65_Zwt), the CD22-65s_Zwt CAR, the m971_Zmut CAR, and the m971s_Zmut CAR as determined using flow cytometric analysis.

Before cryopreserving, the percentage of cells transduced (expressing the CD22-specific CAR on the cell surface) were determined by flow cytometric analysis on a FACS Fortessa (BD) (FIG. 12). The viral transduction showed comparable expression levels, indicating similar transduction efficiency as well as surface expression of the respective CARs. The cell counts of the CAR T cell cultures indicate that there is no detectable negative effect of the human CD22 CARs on the cells' ability to expand normally when compared to the untransduced T cells ("UTD").

Evaluating Potency of CD22 CAR-Redirected T Cells:

To evaluate the functional abilities of CD22 CAR T cells, the cells, generated as described above, were thawed, counted and co-cultured with cancer cells to read out their killing capabilities, secretion of cytokine as well as proliferation. Human scFv bearing CARs CD22-65_Zmut, CD22-65_Zwt, CD22-65s_Zwt, m971_Zmut, and m971s_Zmut were used and compared to a CD19 CAR as well as non-transduced T cells (UTD), which were used as non-targeting T cells control.

Figure 13A:
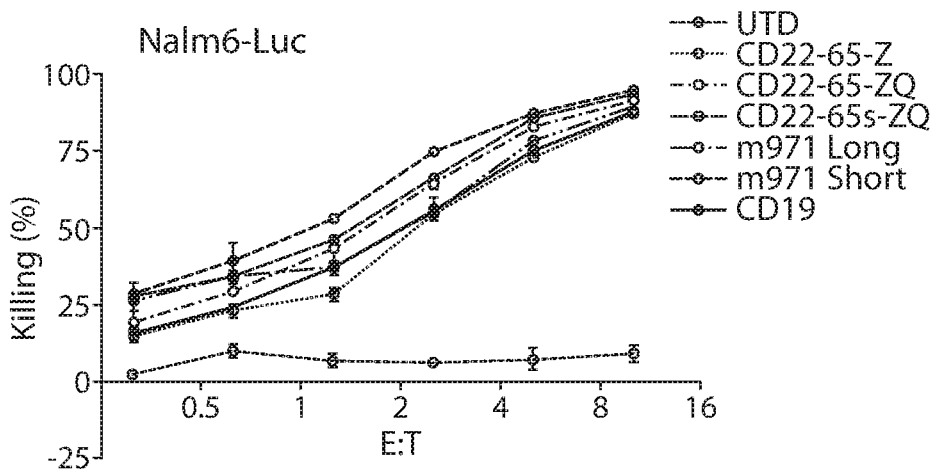
FIGS. 13A-C are graphs showing that CD22-65_Zmut, CD22-65_Zwt, CD22-65s_Zwt, m971_Zmut, and m971s_Zmut CAR T cells effectively kill CD22 expressing target cells. A 20 h killing assay of CAR T cells with the ALL line Nalm6 (FIG. 13A), ALL line SEM (FIG. 13B), and CD22-negative CML line K562 (FIG. 13C) are shown. Non-transduced T cells (UTD) and CD19 cells are also shown. CARTs and target cells were co-cultured at different effector-to-target cell ratios (E:T) for 20 h, after which luciferase-expressing target cells were quantified using luminescence.
Figure 13B:
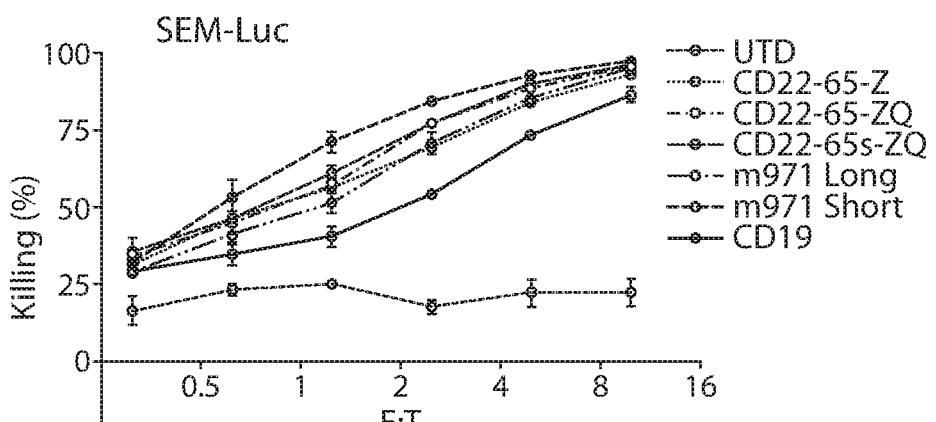
Figure 13C:
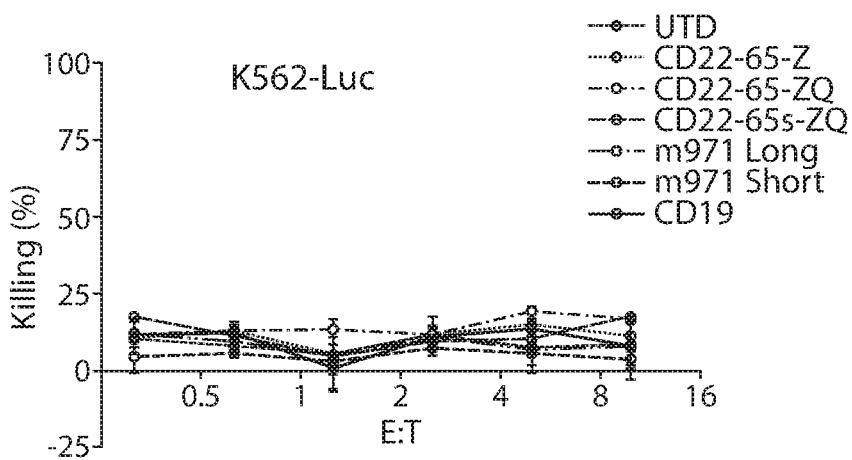

T cell killing was directed towards the acute lymphoblastic leukemia (ALL) lines Nalm6 (RRID: CVCL_0092) and SEM (RRID: CVCL_0095); K562 (RRID: CVCL_0004), a chronic myelogenous leukemia (CML) cell line served as CD22-negative/low control. All cell lines were transduced to express luciferase as a reporter for cell viability/killing. The cytolytic activities of CD22 CARTs were measured at a titration of effector:target cell ratios (E:T) of 10:1, 5:1, 2.5:1, 1.25:1 0.63:1 and 0.31:1. Assays were initiated by mixing the respective number of T cells with a constant number of targets cells (25,000 cells per well of a 96-well plate). After 20 hours, remaining cells in the wells were lysed by addition of Bright-Glo™ Luciferase Assay System (Promega) reagent, to quantify the remaining Luc-expressing cancer cells in each well. "% Killing" was calculated in relation to wells containing target cells alone (0%, maximal Luc signal). The data show that transduction with the CD22 CART encoding lentiviruses transfers anti-CD22 killing activity to T cells in Nalm6 (FIG. 13A)) and SEM (FIG. 13B)). UTD T cells show background killing only. Similarly, none of the CD22 CARs show killing of the CD22-negative control line K562 (FIG. 13C). All CARs showed high killing of both Nalm6 and SEM target cell lines, with m971s_Zmut, CD22-65s_Zwt and CD22-65_Zwt being the top 3.

Figure 14:
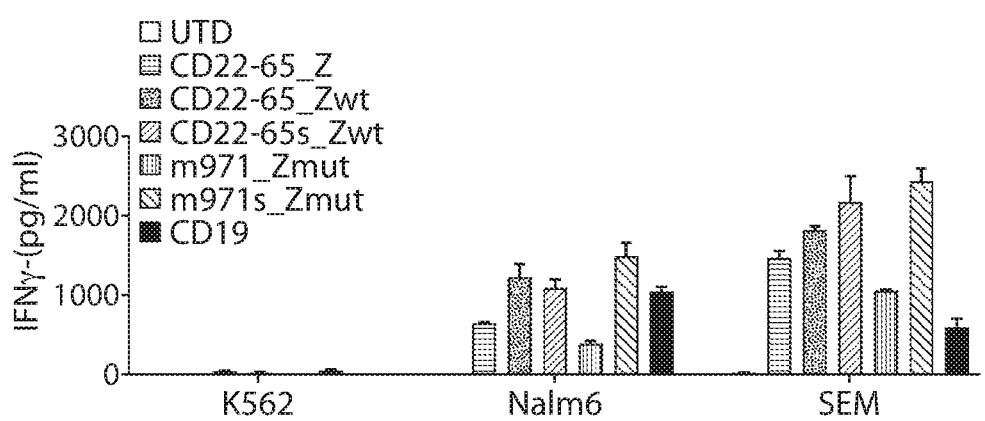
FIG. 14 is a graph showing that CD22-65_Zmut, CD22-65_Zwt, CD22-65s_Zwt, m971_Zmut, m971s_Zmut, CD19, and UTD CAR T cells secrete IFN-γ in response to stimulation by CD22 expressing target cells. IFN-γ was measured in the media of co-cultures of CAR T cells with the ALL line Nalm6, ALL line SEM, and CD22-negative CML line. CARTs and target cells were co-cultured at an effector-to-target cell ratio of 1:1 for 24 h, after which supernatants were harvested and IFN-γ amounts were quantified.

To measure cytokine production of CD22 CAR T cells in response to CD22-expressing target cells, CAR T cells were co-cultured with the same ALL lines as above plus K562, serving as CD22-negative/low control. Cells were cultured at an effector:target ratio of 1:1 and 25,000 cells per well of a 96-well plate for 24 h, after which the media was removed for cytokine analysis using the V-PLEX Human IFN-γ Kit (Meso Scale Diagnostics). These data show that all CD22 CARTs as well as the CD19 CARTs produced IFN-γ when cultured with Nalm6 or SEM (FIG. 14). m971s_Zmut, CD22-65s_Zwt and CD22-65_Zwt were the highest cytokine producers. Levels of cytokine produced by CD22 CARTs after exposure to the control K562 cells were low, indicating no unspecific effects by CD22 CARs.

Figure 15A:
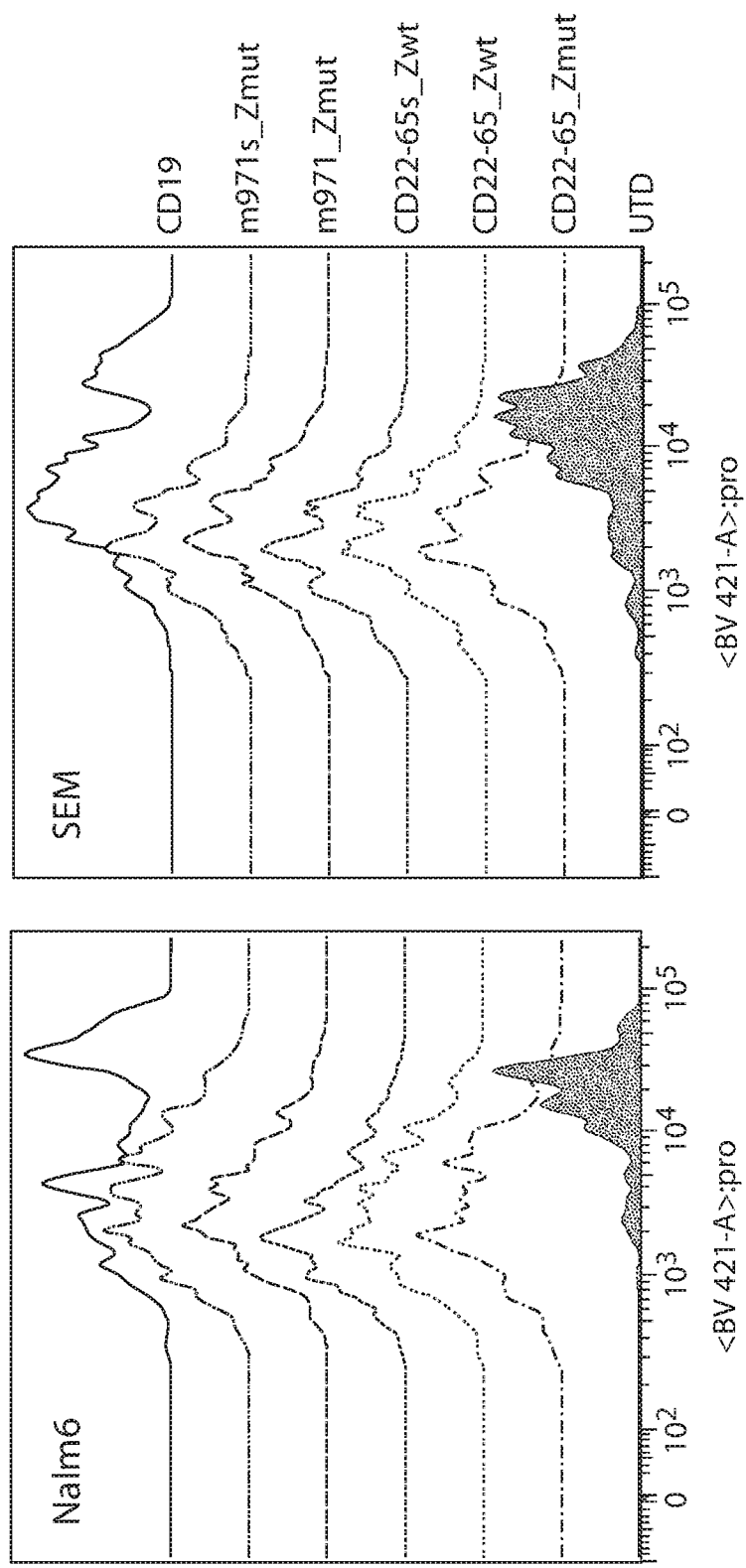
FIGS. 15A-B are graphs showing proliferation of the CD22-65_Zmut, CD22-65_Zwt, CD22-65s_Zwt, m971_Zmut, m971s_Zmut, CD19, and UTD CAR T cells co-cultured with the ALL lines Nalm6 and SEM as assessed using a cell tracer violet dye. A lower fluorescence shows a stronger proliferation as each cell division of the T cells leads to retention of half the fluorescence in each daughter cell (FIG. 15A). Non-divided cells show high fluorescence as shown for UTD. The cell proliferation is quantified and reported as "Division Index" using FlowJo software (FIG. 15B).
Figure 15B:
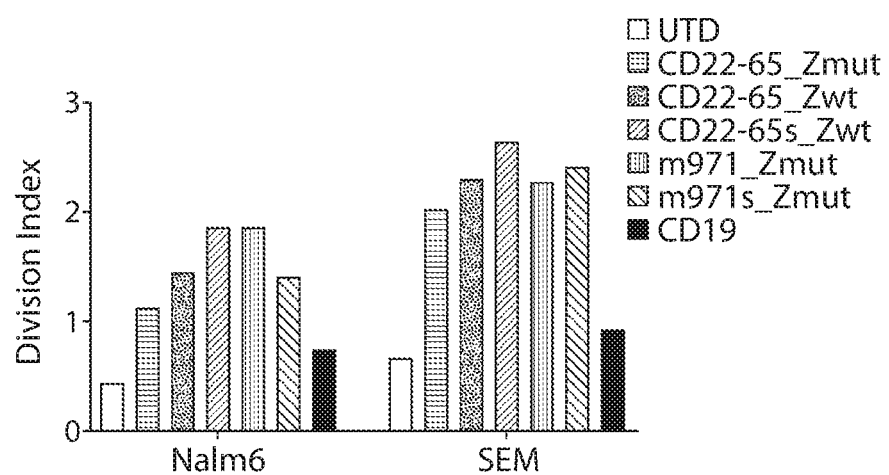

In the last T cell efficacy assay, the proliferative capacity of the CD22 CAR T cells was assessed. Again, thawed CAR T cells we co-cultured with the ALL lines Nalm6 and SEM. CARTs were stained with CellTracer Violet dye (Thermo-Fisher Scientific) and target cell lines were irradiated prior to co-culture to prevent overgrowth in the wells. They were then cultured at an effector:target ratio of 1:1 and 30,000 cells per well in a 96-well plate for 4 days. On day 4, cells were stained with anti-CD3 antibody as well as soluble CD22-Fc to detect CAR expression. From the intensity of the violet dye of all CD3+ T cells; the lower the fluorescence, the stronger the proliferation, as each cell division of the T cells leads to retention of half the fluorescence in each daughter cell (FIG. 15A). Non-divided cells show high fluorescence as seen for UTD. The cell proliferation is quantified and reported as "Division Index" using FlowJo software (FIG. 15B). Here, CD22-65s_Zwt was among the best proliferating CARTs in response to Nalm6 and showed the highest proliferation in response to SEM and.

All CD22-specific CARs in this experiment were expressed on the cell surface of primary human T cells similarly well: CD22-65_Zmut, CD22-65_Zwt, CD22-65s_Zwt, m971_Zmut, and m971s_Zmut. While all CD22 CARTs showed efficacy in T cell functional assays, m971s_Zmut, CD22-65s_Zwt and CD22-65_Zwt were the top 3 CARTs in all 3 assays. Overall, the transfer of CD22 CARs induced anti-CD22 reactivity but no off-target function was detected.

Example 9: In Vivo Activity of CARTs Bearing Human Anti-CD22 scFv with Short Linkers Anti-tumor activity of a set of CD22 CAR T cells was assessed in vivo in a NALM6 and a SEM xenograft model. CAR T cells with CAR constructs CD22-65_Zmut, CD22-65_Zwt, CD22-65s_Zwt, m971_Zmut, and m971s_Zmut were evaluated.

Cell Lines:

Both Nalm6 (RRID: CVCL_0092) and SEM (RRID: CVCL_0095) are human acute lymphoblastic leukemia (ALL) cell lines. Cells were grown in RMPI medium containing 10% fetal bovine serum and both grow in suspension. Both cell lines persist and expand in mice when implanted intravenously. Cells have been modified to express luciferase, so that that tumor cell growth can also be monitored by imaging the mice after they have been injected with the substrate Luciferin.

Mice:

6 week old NSG (NOD.Cg-PrkdcscidIl2rgtm1Wjl/SzJ) mice were received from the Jackson Laboratory (stock number 005557). Animals were allowed to acclimate in the Novartis NIBR animal facility for at least 3 days prior to experimentation. Animals were handled in accordance with Novartis ACUC regulations and guidelines. Electronic transponders for animal identification were implanted on the left flank one day prior to tumor implantation.

Tumor Implantation:

Cells in logarithmic growth phase were harvested and washed in 50 ml falcon tubes at 1200 rpm for 5 minutes, once in growth media and then twice in cold sterile PBS. Cells were resuspended in PBS at a concentration of $5 \times 10^6$ per ml, placed on ice, and injected in mice. Cancer cells were injected intravenously in 200 μl through the caudal vein. Both, the Nalm6 and SEM models endogenously express CD22 and thus, can be used to test the efficacy of CD22-directed CAR T cells in vivo. These models grow well when implanted intravenously in mice, which can be imaged for tumor burden measurements. Upon injection of $1 \times 10^6$ cancer cells, the tumors establish and can be accurately measured within 3 days. Baseline measurements are $4-6 \times 10^5$ photons/second (p/s). Within 7 days the mean bioluminescence measurement is $2-4 \times 10^6$ p/s and untreated tumors reach endpoint measurement ($2-3 \times 10^9$) by 21-26 days. Anti-tumor activities of therapeutic agents are often tested once tumors are fully engrafted. Thus, there is a large window with these models during which the anti-tumor activity of CAR T cells can be observed.

CAR T Cell Dosing:

Mice were dosed 7 days after tumor implantation, with $1 \times 10^6$ CAR T cells for the treatment of Nalm6 and $3 \times 10^6$ CAR T cells for the treatment of SEM. Cells were partially thawed in a 37° C. water bath and then completely thawed by the addition of 1 ml of warmed growth media. The thawed cells were transferred to a 50 ml falcon tube and adjusted to a final volume of 12 ml with growth media. The cells were washed twice and spun at 300 g for 10 minutes and then counted by hemocytometer. T cells were then resuspended at respective concentrations in cold PBS and kept on ice until the mice were dosed. The CARTs were injected intravenously via the tail vein in 200 al, for a dose of 1 or $3 \times 10^6$ CAR T cells for Nalm6 and SEM bearing mice, respectively. 5 mice per group were either treated with 200 μl of PBS alone (PBS), non-transduced T cells (UTD), CD19 CAR T cells, as well as the novel CD22-65_Zmut, CD22-65_Zwt, CD22-65s_Zwt, m971_Zmut, or m971s_Zmut CAR T cells. All cells were prepared from the same donor in parallel.

Animal Monitoring:

The health status of the mice was monitored daily, including twice weekly body weight measurements. The percent change in body weight was calculated as (BWcurrent−BWinitial)/(BWinitial)×100%. Tumors were monitored 2 times weekly by imaging the mice.

The anti-tumor activity of CD22 CAR T cells was assessed in two B-cell acute lymphoblastic leukemia xenograft models. Following tumor cell implantation on day 0, tumor bearing mice were randomized into treatment groups and CAR T cells were administered intravenously via the lateral tail vein on day 7 after tumor implantation. Tumor growth and animal health were monitored until animals achieved endpoint.

Figure 16:
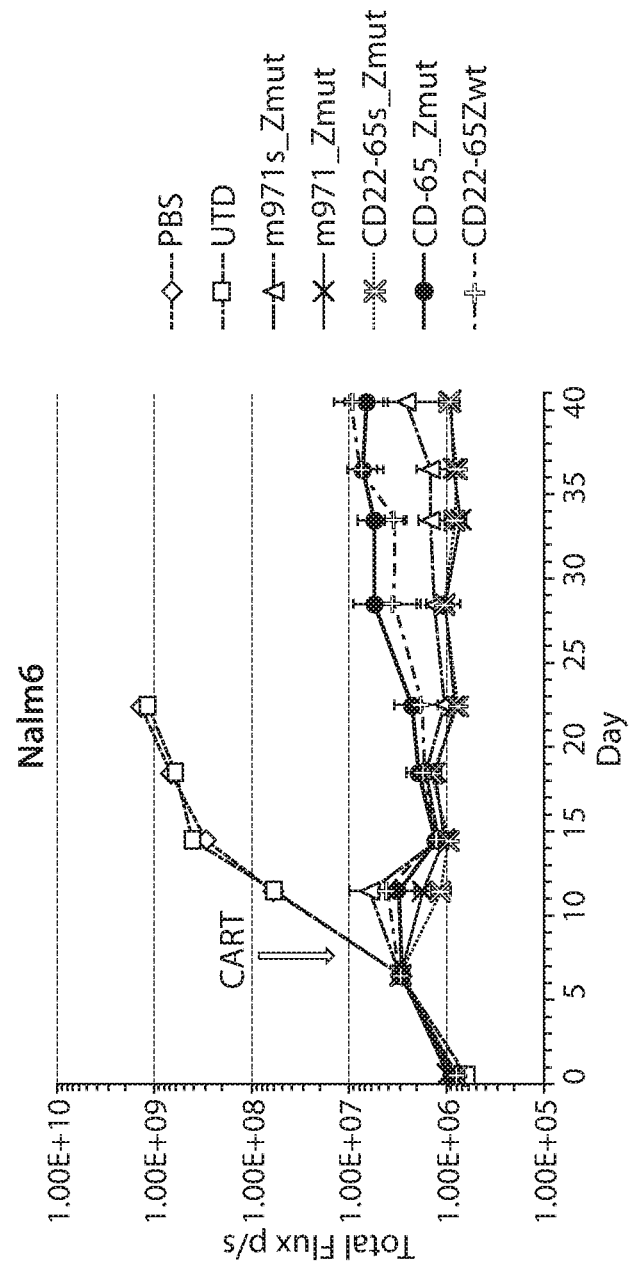
FIG. 16 is a graph showing tumor regression as indicated from mean bioluminescence in Nalm6 mice treated with CD22-65_Zmut, CD22-65_Zwt, CD22-65s_Zwt, m971_Zmut, or m971s_Zmut CAR T cells. Treatment also included T cells with UTD, or PBS.

In the Nalm6 model, mice which received PBS or UTD T cells were euthanized on day 22, when tumors were causing decreased hind leg mobility. All other groups were euthanized on day 40. The PBS treatment group, which did not receive any T cells, demonstrates baseline Nalm6 tumor growth kinetics in intravenously injected NSG mice. The UTD treatment group received non-transduced T cells and served as a T cell control to show the non-specific response of human donor T cells in this model. Both the PBS and UTD treatment groups demonstrated continuous tumor progression throughout this study. CD22-65_Zmut, CD22-65_Zwt, CD22-65s_Zwt, m971_Zmut, and m971s_Zmut CAR T cells all showed significantly slower tumor growth. CD22-65s_Zwt and m971_Zmut showed complete tumor regression as indicated from mean bioluminescence (FIG. 16).

In the SEM model, mice which received PBS or UTD T cells were euthanized on day 27, when tumors were causing decreased hind leg mobility. All other groups were euthanized on day 45. The PBS treatment group, which did not receive any T cells, demonstrates baseline SEM tumor growth kinetics in intravenously injected NSG mice. The UTD treatment group received non-transduced T cells and served as a T cell control to show the non-specific response of human donor T cells in this model. Both the PBS and UTD treatment groups demonstrated continuous tumor progression throughout this study.

Figure 17A:
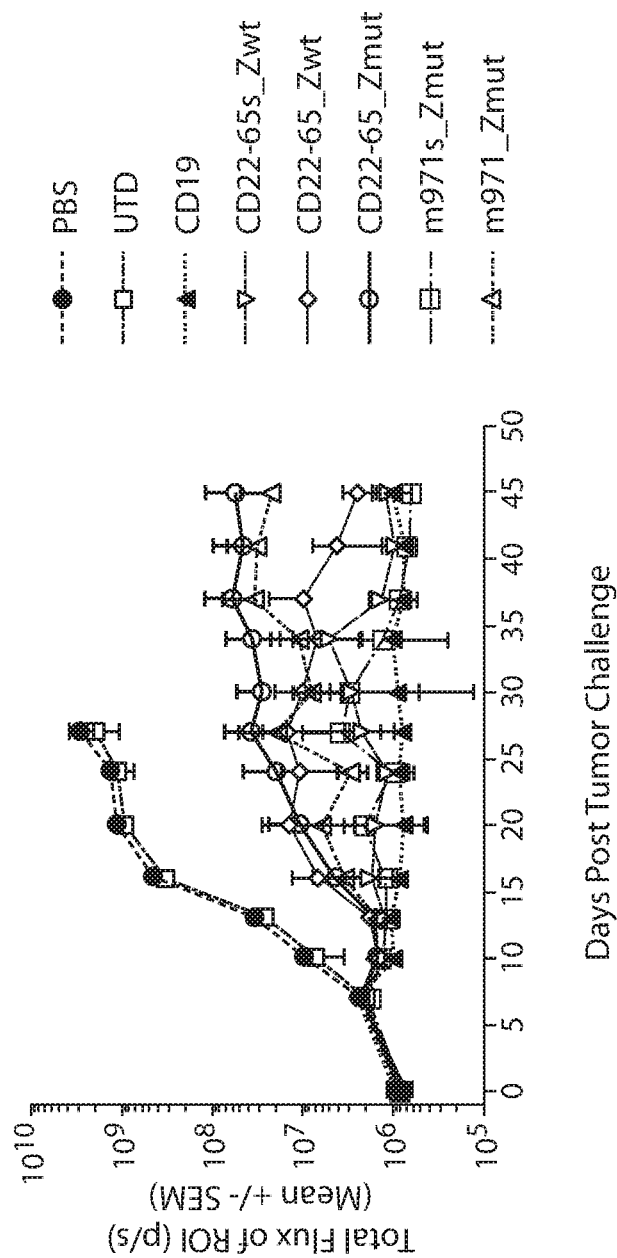
FIGS. 17A-B are graphs showing tumor growth of SEM mice treated with CD22-65_Zmut, CD22-65_Zwt, CD22-65s_Zwt, m971_Zmut, or m971s_Zmut CAR T cells or UTD or PBS.
Figure 17B:
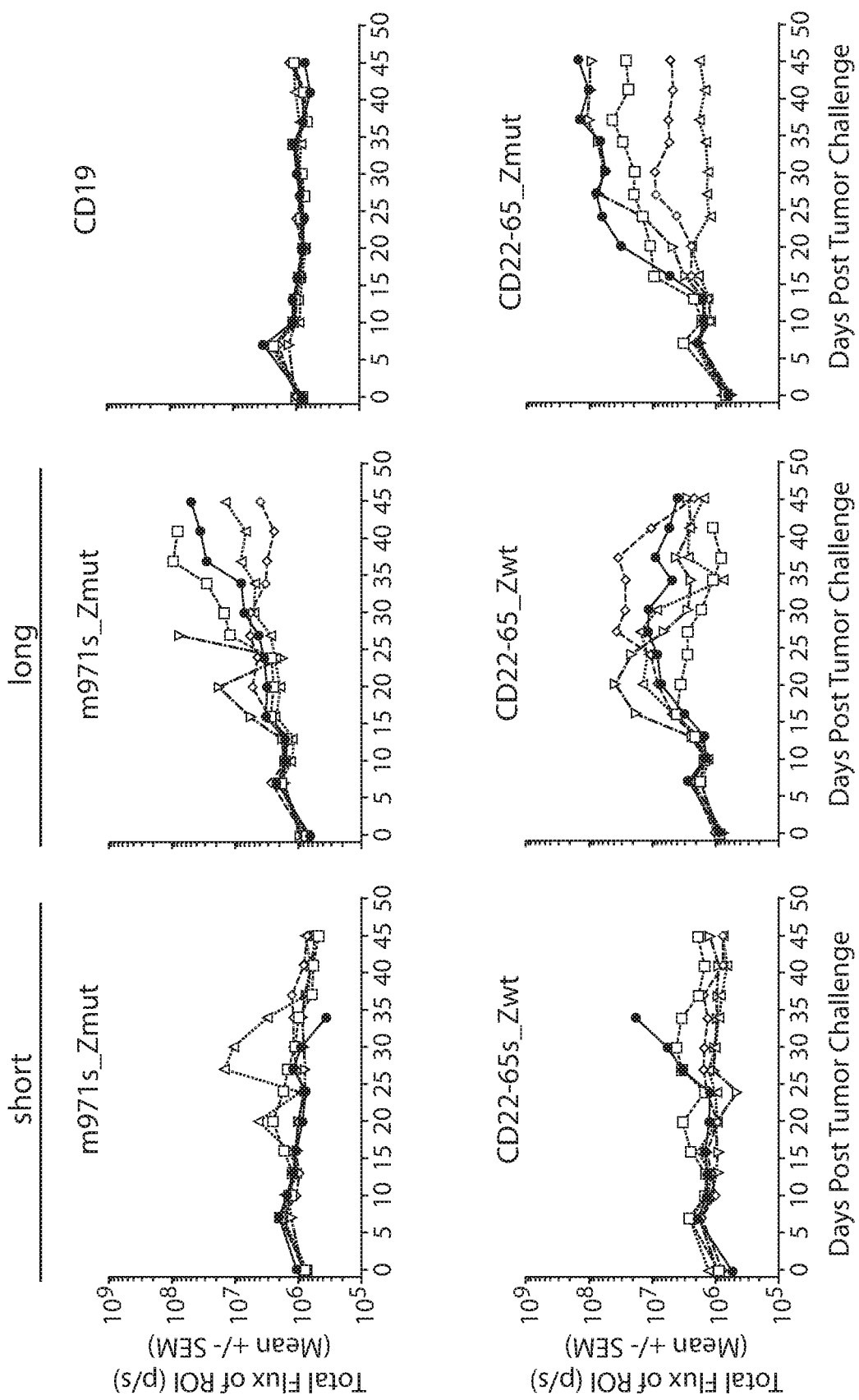

CD22-65_Zmut, CD22-65_Zwt, CD22-65s_Zwt, m971_Zmut, m971s_Zmut, and CD19 CAR T cells all showed significantly slower tumor growth. CD19 CARTs showed fastest tumor regression, followed by CD22-65s_Zwt and m971s_Zmut (FIG. 17A). Bioluminescence curves were also generated for single mice in the respective groups, highlighting the stronger efficacy of both CD22-65s_Zwt and m971s_Zmut as compared to the CAR variants with the longer linkers within the scFv (CD22-65_Zwt and m971_Zmut, respectively (FIG. 17B). This study demonstrated that the CD22-specific CAR T cells CD22-65s_Zwt are capable of leading to the regression of both NALM6 and SEM tumors. The efficacy was comparable to m971 CAR variants and higher as compared to the CD22-65 variants with the long linker.

Figure 18:
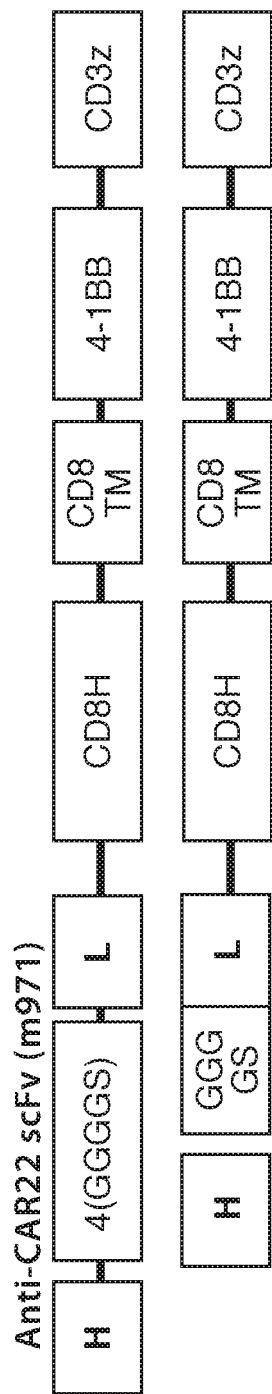
FIG. 18 is a schematic of an anti-CD22 CAR including a longer linker (4×(GGGGS) (SEQ ID NO: 1086); LL) and an anti-CD22 CAR including a short linker (1×(GGGGS) (SEQ ID NO: 1083); SL) between the light and heavy chains.

Example 10: Clinical Efficacy of Anti-CD22 CAR T Cells for B-Cell Acute Lymphoblastic Leukemia Correlates with scFv Linker Length and can be Predicted Using a Xenograft Model Patients and Methods:

An anti-CD22 CAR ("CD22 CAR") including a longer linker (4×(GGGGS) (SEQ ID NO: 1086); LL) compared to anti-CD22 CAR including a short linker (1×(GGGGS) (SEQ ID NO: 1083); SL) between the light and heavy chains of the scFv was generated (FIG. 18). The CD22 CAR LL construct was tested in two pilot clinical trials in adults (NCT02588456) and children with r/r-ALL (NCT02650414). CART22$^{LL}$ T cells were generated using lentiviral transduction. The protocol-specified CART22 dose was $2 \times 10^6 - 1 \times 10^7$ cells/kg for pediatric patients <50 kg and $1-5 \times 10^8$ for pediatric patients >50 kg and adult patients, infused after lymphodepleting chemotherapy. Patient characteristics are described in Table 16.

TABLE 16

Patient characteristics of patients infused with CART22$^{LL}$ T cells.

| Characteristic | Pediatric ALL (n = 6) Value (range, %) | Adult ALL (n = 3) |
|---|---|---|
| Age median (range) | 14 years (4-25) | 47 years (28-64) |
| Gender (%) | 3 M (50%)/3 F (50%) | 2 M (66.6%)/1 F (33.3%) |
| Race | 5 caucasian/1 asian | 3 caucasian |
| Prior allogeneic transplantation (%) | 5/6 (83.3%) | 1/3 (33.3%) |
| Prior blinatumomab or CART19 (%) | 5/6 (83.3%) CART19 1/6 (16.6%) blinatumomab | 1/3 (33.3%) CART19 3/3 (100%) blinatumomab |
| BM blast pre CART22 % (range) | 77.5% (0.6-95) | 95% (0-97) |
| | 5/6 (83.3%) CD19− relapse 1/6 (16.6%) CD19+ relapse | 1/3 (33.3%) CD19− relapse 2/3 (66.6%) CD19+ relapse |
| CART22 dose median (range) | $3.55 \times 10^8$ ($3.96 \times 10^7$-$5 \times 10^8$) | $2 \times 10^8$ ($5 \times 10^7$-$5 \times 10^8$) |
| CAR expression | 36.4% (15-49.7) | 25.8% (25-30) |

For the adult trial, 5 patients were screened, 4 enrolled (1 patient withdrew consent) and 3 infused (1 manufacturing failure). For the pediatric trial, 9 patients were screened, 8 enrolled (1 screen failure) and 6 infused (two patients were not infused for disease progression).

For the preclinical studies, CART22$^{LL}$ and CART22$^{SL}$ were generated and tested in vivo using xenograft models. NSG mice were engrafted with either a luciferase+ standard B-ALL cell line (NALM6) or primary B-ALL cells obtained from a patient relapsing after CART19 (CHP110R). Additionally, 2-photon imaging was used to study the in vivo behavior and immune synapse formation and flow cytometry to asses T cell activation.

Figure 19:
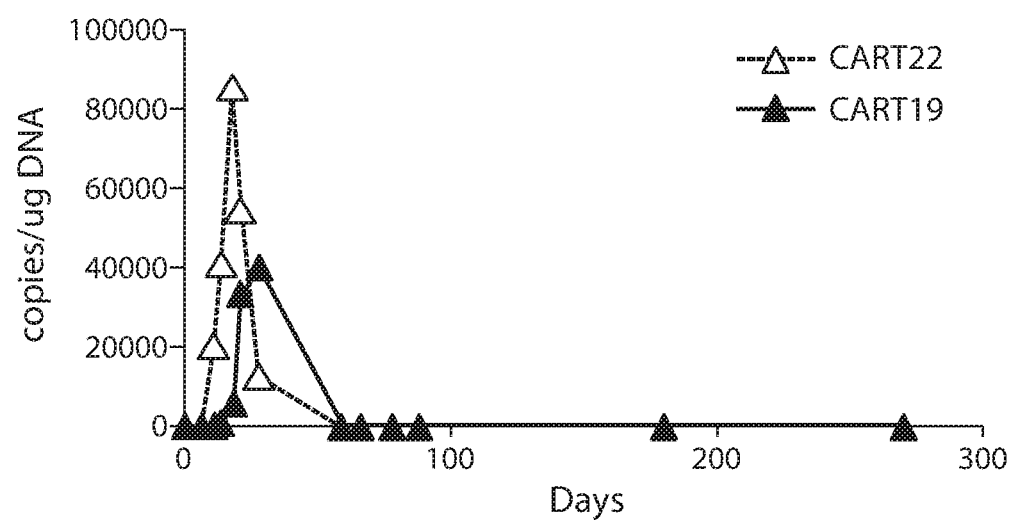
FIG. 19 is a graph showing the amount of DNA (copies/ug) of CART19 and CART22 cells in an adult patient with ALL who had previously received treatment with CART19 cells and was treated with CART22 cells. A second CART19 cell re-expansion after expansion with CART22 cells.

CART22 cells were successfully manufactured for 10 out of 12 patients. In the adult cohort, 3/3 patients developed CRS (gr.1-3) and no neurotoxicity was observed; in the pediatric cohort out of 5 evaluable patients (1 discontinued for lineage switch to AML on pre-infusion marrow), 3/5 developed cytokine-release syndrome (CRS) (all grade 2) and 1 patient had encephalopathy (gr.1). CART22 cells were expanded in the PB with median peak of 1977 (18-40314) copies/ug DNA at day 11-18. In an adult patient who had previously received CART19, a second CART19 re-expansion was observed following CART22 expansion (FIG. 19). At day 28 in the adult cohort, the patient who was infused in morphologic CR remained in CR, while the other two had no response (NR). In the pediatric cohort, two out of five patients were in CR, one patient was in partial remission (PR) that then converted to CR with incomplete recovery at 2 months, and two had NR. No CD22-negative leukemia progression was observed.

Figure 20:
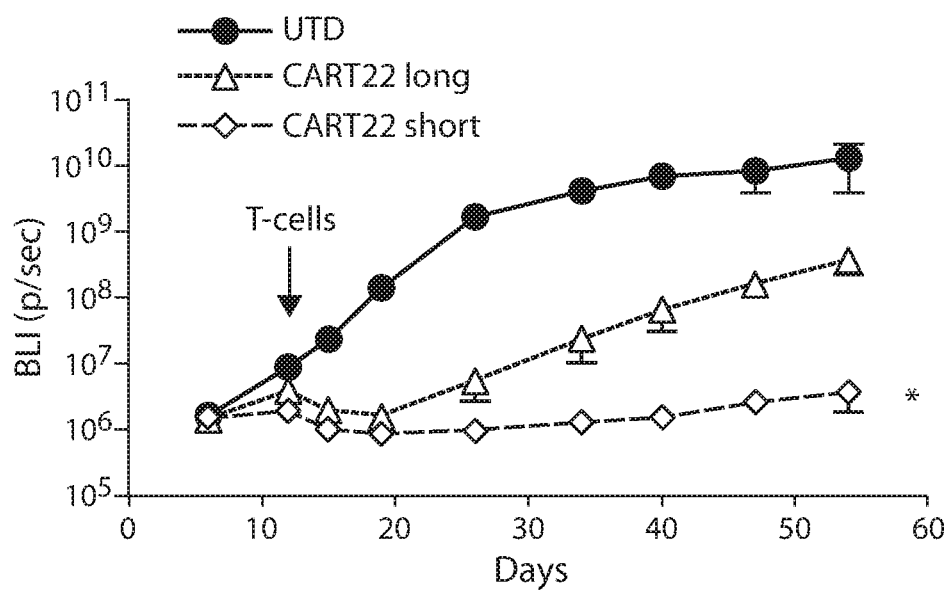
FIG. 20 is a graph showing overall survival of NSG mice engrafted with NALM6 or CHP110R treated with CART22 cells with a CAR22 including a short linker (CART22$^S$) or a long linker (CART22$^{SL}$).
Figure 21:
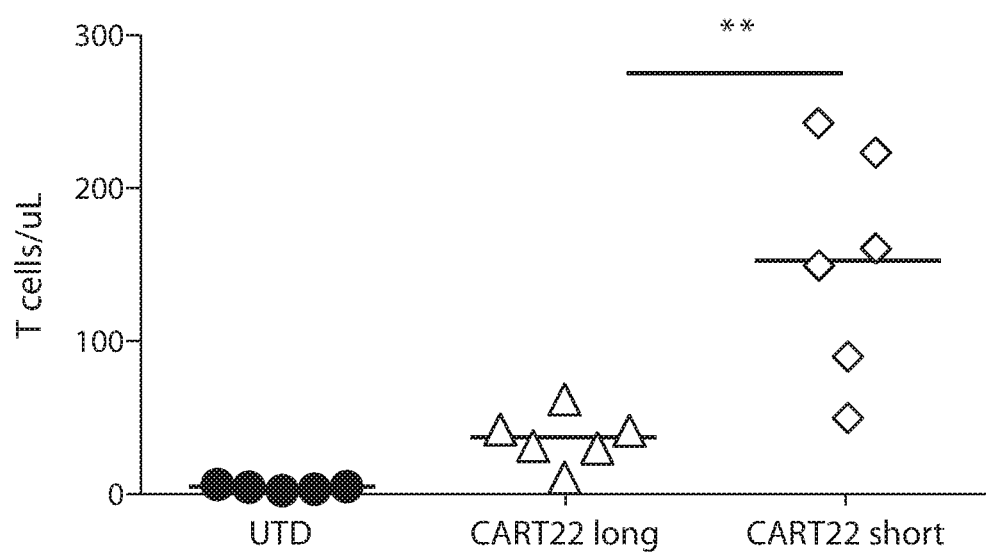
FIG. 21 is a graph showing that CART22$^{SL}$ cells showed higher in vivo proliferation at day 17 than CART22$^{LL}$ cells in NSG mice as assessed using flow cytometry.
Figure 22:
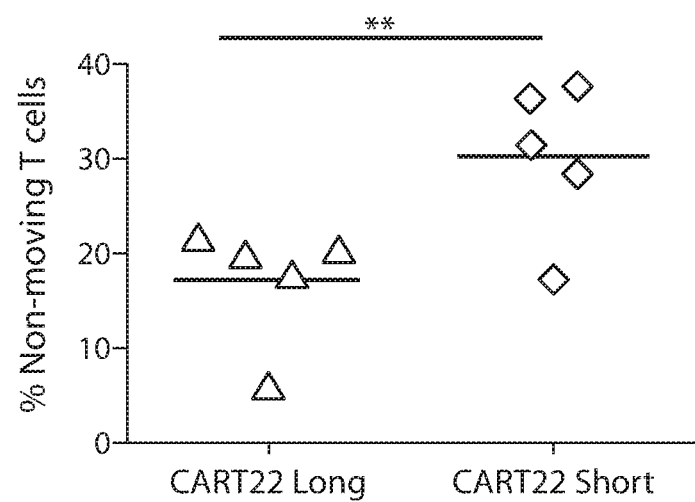
FIG. 22 is a graph showing that CART22$^{SL}$ cells established more protracted T cell:leukemia interactions than CART22$^{LL}$ cells in NSG mice as assessed using intravital 2-photon imaging.

A direct comparison of the two different CAR22 constructs (CART22$^S$ and CART22$^{SL}$) was then performed. In xenograft models, CART22$^{SL}$ significantly outperformed CART22LL (FIG. 20) with improved overall survival. Moreover, CART22$^{SL}$ showed higher in vivo proliferation at day 17 (FIG. 21). Mechanistically, intravital 2-photon imaging showed that CART22$^{SL}$ established more protracted T cell:leukemia interactions than did CART22L, suggesting the establishment of productive synapses (FIG. 22). Moreover, in vivo at 24 hrs higher T cell activation (CD69, PD-1) was observed in CART22$^{SL}$ from the BM of NALM-6-bearing mice.

Although feasible and with manageable toxicity, CART22$^{LL}$ led to modest clinical responses for patients with r/r B-ALL. Preclinical evaluation allowed us to conclude that shortening the linker by 15 amino acids significantly increases the anti-leukemia activity of CART22, possibly by leading to more effective interactions between T cells and their targets. Finally, with the caveats of cross-trial comparison, these data suggest that xenograft models can predict the clinical efficacy of CART products and validate the use of In vivo models for lead candidate selection.

Example 11: In Vitro Activity of CARTs Bearing Human Anti-CD22 scFv with Linker Variants Genes encoding for single chain variable fragments for anti-CD22 antibodies were cloned into lentiviral CAR expression vectors with the CD3zeta chain and 4-1BB stimulatory molecules. The following anti-CD22 CAR constructs were evaluated: CD22-65_Zwt, CD22-65s_Zwt (short 1×(GGGGS) linker (SEQ ID NO: 1083); SEQ ID NO: 835), CD22-65ss_Zwt (no linker between the VH and VL regions; SEQ ID NO: 836), CD22-65sLH_Zwt (short 1×(GGGGS) linker (SEQ ID NO: 1083) with the VL region oriented at the N-terminus and the VH region oriented at the C-terminus), CD22-65sKD_Zwt (short 1×(GGGGS) linker (SEQ ID NO: 1083) and mutations in the FR regions of the VH and VL regions; SEQ ID NO: 837), and CD22-m971s_Zmut (control) were evaluated. Except for CD22-65sLH_Zwt, all anti-CD22 CAR constructs have the VH region oriented at the N-terminus.

The CD3zeta chain was either wildtype (Zwt) or carried a Q65K mutation (Zmut). The constructs were ranked based on the effector T cell responses of these CD22 CAR-transduced T cells ("CD22 CART" or "CD22 CAR T cells") in response to CD22 expressing ("CD22+") targets. Effector T cell responses include, but are not limited to, cellular expansion, proliferation, doubling, cytokine production and target cell killing or cytolytic activity (degranulation).

Generation of CD22 CAR T Cells:
Human scFv encoding lentiviral transfer vectors were used to produce the genomic material packaged into the VSVg pseudotyped lentiviral particles. Lentiviral transfer vector DNA encoding the CAR was mixed with the three packaging components VSVg, gag/pol and rev in combination with lipofectamine reagent to transfect Lenti-X 293T cells (Clontech), followed by medium replacement 12-18h later. 30 hours after medium change, the media is collected, filtered and stored at −80° C.

CD22 CAR T cells were generated by starting with blood from healthy apheresed donors whose T cells were enriched by negative selection of T cells, CD4+ and CD8+ lymphocytes (Pan T cell isolation, Miltenyi). T cells were activated by the addition of CD3/CD28 beads (DYNABEADS® Human T-Expander CD3/CD28, ThermoFisher Scientific) at a ratio of 1:3 (T cell to bead) in T cell medium (RPMI1640, 10% heat-inactivated fetal calf serum (FCS), 2 mM L-glutamine, 1x Penicillin/Streptomycin, 100 µM non-essential amino acids, 1 mM Sodium Pyruvate, 10 mM Hepes, and 55 µM 2-mercaptoethanol) at 37° C., 5% CO2. T cells were cultured at 0.5×10$^6$ T cells in 1 mL medium per well of a 24-well plate. After 24 hours, when T cells were blasting, non-concentrated or concentrated viral supernatant was added; T cells were transduced at a multiplicity of infection (MOI) of 5. T cells began to proliferate, which is monitored by measuring the cell concentration (as counts per mL), and T cells are diluted in fresh T cell medium every two days. As the T cells began to rest down after approximately 10 days, the logarithmic growth wanes. The combination of slowing growth rate and reduced T cell size (approaching 350 fL) determines the state for T cells to be cryopreserved for later analysis. All CD22 CAR T cells were produced under research grade (i.e., not clinical grade) manufacturing conditions.

Figure 23:
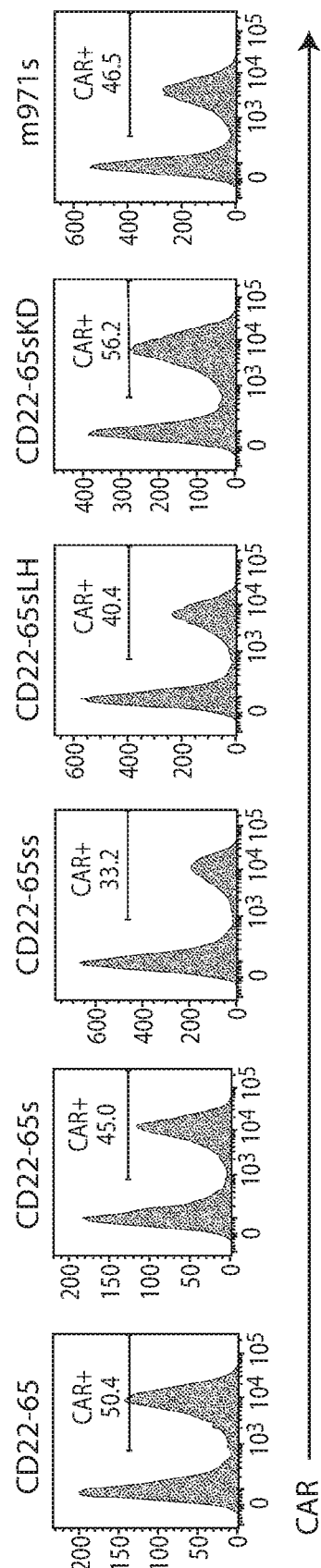
FIG. 23 is a graph showing the expression level of CD22-65_Zwt, CD22-65s_Zwt (short 1×(GGGGS) linker (SEQ ID NO: 1083); SEQ ID NO: 835), CD22-65ss_Zwt (no linker between the VH and VL regions; SEQ ID NO: 836), CD22-65sLH_Zwt (short 1×(GGGGS) linker (SEQ ID NO: 1083) with the VL region oriented at the N-terminus and the VH region oriented at the C-terminus), CD22-65sKD_Zwt (short 1×(GGGGS) linker (SEQ ID NO: 1083) and mutations in the FR regions of the VH and VL regions; SEQ ID NO: 837), and CD22-m971s_Zmut (control) in T cells as determined using flow cytometric analysis.

Before cryopreserving, the percentage of cells transduced (expressing the CD22-specific CAR on the cell surface) were determined by flow cytometric analysis on a FACS Fortessa (BD) (FIG. 23). The viral transduction showed comparable expression levels, indicating similar transduction efficiency as well as surface expression of the respective CARs. The cell counts of the CAR T cell cultures indicate that there is no detectable negative effect of the human CD22 CARs on the cells' ability to expand normally when compared to the untransduced T cells ("UTD").

Figure 24A:
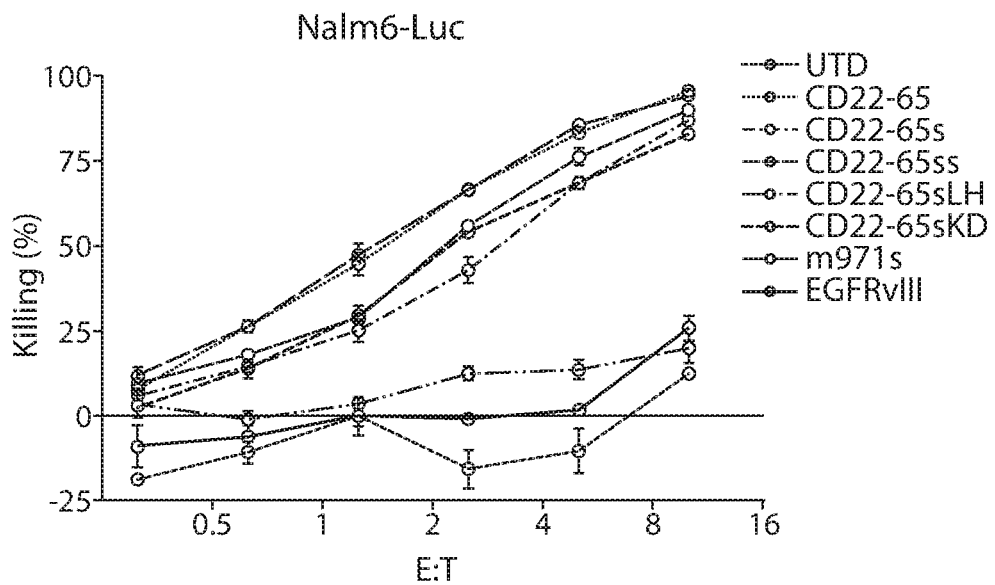
FIGS. 24A-B are graphs showing that CD22 CAR T cells bearing human anti-CD22 scFv with a short linker (short 1×(GGGGS) linker (SEQ ID NO: 1083); SEQ ID NO: 835) or no linker effectively kill CD22 expressing target cells. A 20 h killing assay of CAR T cells with the acute lymphoblastic leukemia (ALL) lines Nalm6 (FIG. 24A) and SEM (FIG. 24B) is shown.
Figure 24B:
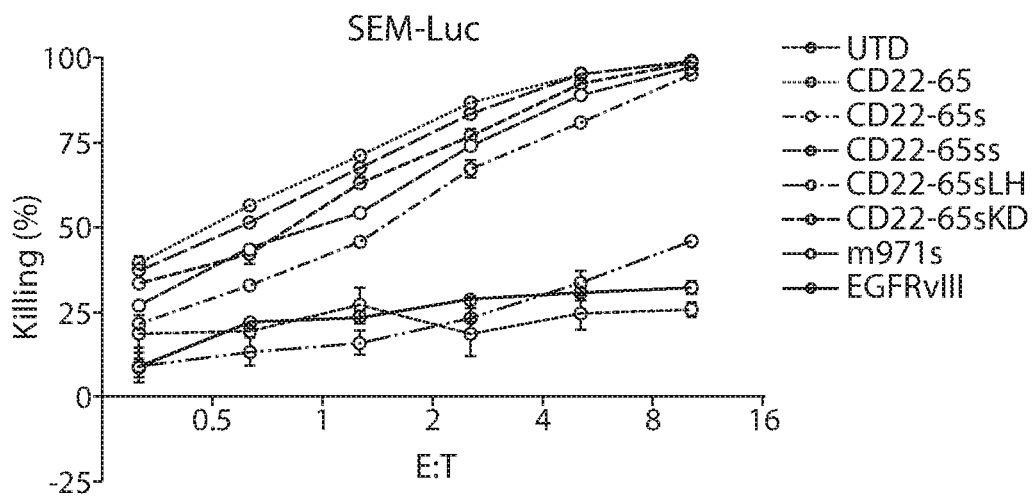

Evaluating Potency of CD22 CAR-Redirected T Cells:
To evaluate the functional abilities of CD22 CAR T cells, the cells, generated as described above, were thawed, counted and co-cultured with cancer cells to read out their killing capabilities and secretion of cytokine. Human scFv bearing CARs CD22-65_Zwt, CD22-65s_Zwt, CD22-65ss_Zwt, CD22-65sLH_Zwt, CD22-65sKD_Zwt, and CD22-m971s_Zmut were compared and EGFRvIII CAR T cells as well as non-transduced T cells (UTD) were used as non-targeting T cells control. T cell killing was directed towards the acute lymphoblastic leukemia (ALL) lines Nalm6 (RRID: CVCL_0092) and SEM (RRID: CVCL_0095). Both cell lines were transduced to express luciferase as a reporter for cell viability/killing. The cytolytic activities of CD22 CARTs were measured at a titration of effector:target cell ratios (E:T) of 10:1, 5:1, 2.5:1, 1.25:1 0.63:1 and 0.31:1. Assays were initiated by mixing the respective number of T cells with a constant number of targets cells (25,000 cells per well of a 96-well plate). After 20 hours, remaining cells in the wells were lysed by addition of Bright-Glo™ Luciferase Assay System (Promega) reagent, to quantify the remaining Luc-expressing cancer cells in each well. "% Killing" was calculated in relation to wells containing target cells alone (0%, maximal Luc signal). The data show that transduction with the CD22 CART encoding lentiviruses transfers anti-CD22 killing activity to T cells (Nalm6 and SEM (FIGS. 24A-B)). UTD and EGFRvIII CAR T cells show background killing only. All CARs except CD22-65sLH_Zwt showed high killing of both Nalm6 and SEM target cell lines.

Figure 25:
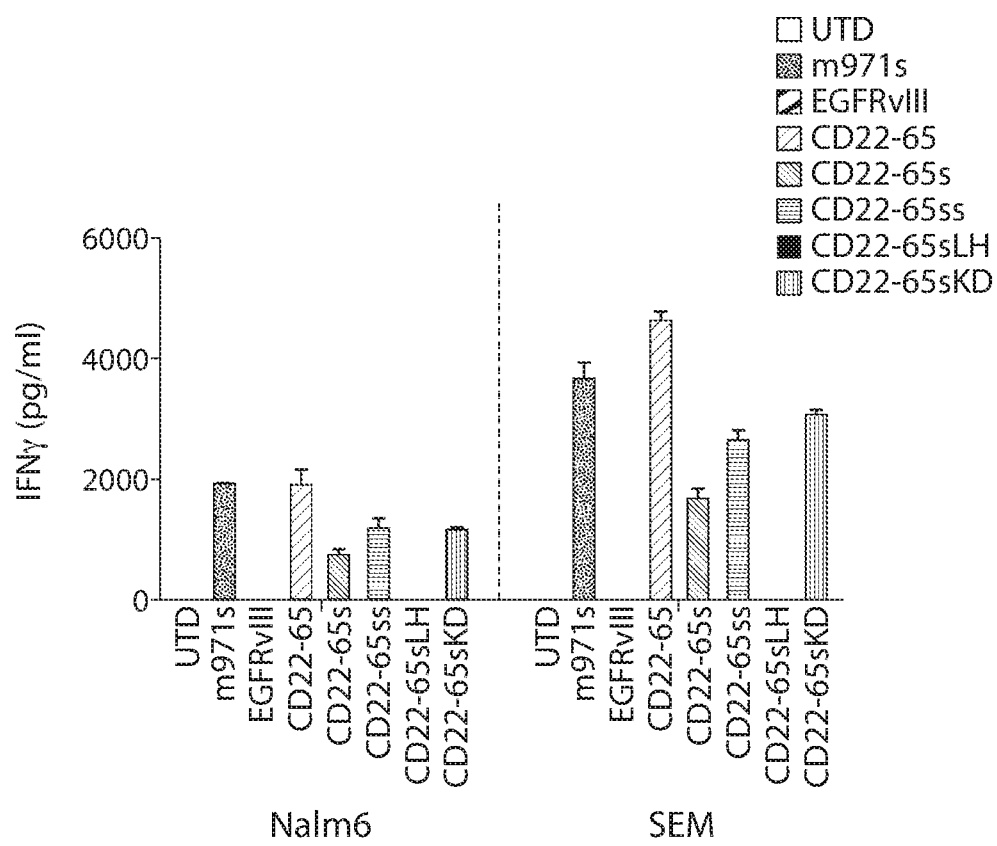
FIG. 25 is a graph showing that the CD22 CAR T cells containing CARs CD22-65_Zwt, CD22-65s_Zwt, CD22-65ss_Zwt, CD22-65sKD_Zwt, and CD22-m971s_Zmu secrete IFN-γ in response to stimulation by CD22 expressing target cells. IFN-γ was measured in the media of co-cultures of CAR T cells with the ALL lines Nalm6 and SEM.

To measure cytokine production of CD22 CAR T cells in response to CD22-expressing target cells, CAR T cells were co-cultured with the same ALL lines as above. Cells were cultured at an effector:target ratio of 1:1 and 25,000 cells per well of a 96-well plate for 24 h, after which the media was removed for cytokine analysis using the V-PLEX Human IFN-γ Kit (Meso Scale Diagnostics). These data show that all CD22 CARTs, except CD22-65sLH_Zwt, produced IFN-γ when cultured Nalm6 or SEM (FIG. 25).

All CD22-specific CARs in this experiment were expressed on the cell surface of primary human T cells similarly well: CD22-65_Zwt, CD22-65s_Zwt, CD22-65ss_Zwt, CD22-65sLH_Zwt, CD22-65sKD_Zwt, and CD22-m971s_Zmut. Additionally, all CD22 CARTs showed efficacy in T cell functional assays, except for CD22-65sLH_Zwt.

Example 12: In Vivo Activity of CARTs Bearing Human Anti-CD22 scFv with Linker Variants Anti-tumor activity of a set of CD22 CAR T cells was assessed in vivo in a NALM6 xenograft model. CAR T cells with CAR constructs CD22-65_Zwt, CD22-65s_Zwt, CD22-65ss_Zwt, CD22-65sLH_Zwt, CD22-65sKD_Zwt, and CD22-m971s_Zmut (control) were evaluated.

Cell Line:

Nalm6 (RRID: CVCL_0092) is a human acute lymphoblastic leukemia (ALL) cell line. Cells were grown in RMPI medium containing 10% fetal bovine serum and both grow in suspension. Cells persist and expand in mice when implanted intravenously. Cells have been modified to express luciferase, so that that tumor cell growth can also be monitored by imaging the mice after they have been injected with the substrate Luciferin.

Mice: 6 week old NSG (NOD.Cg-Prkdc$^{scid}$Il2rg$^{tm1Wjl}$/SzJ) mice were received from the Jackson Laboratory (stock number 005557). Animals were allowed to acclimate in the Novartis NIBR animal facility for at least 3 days prior to experimentation. Animals were handled in accordance with Novartis ACUC regulations and guidelines. Electronic transponders for animal identification were implanted on the left flank one day prior to tumor implantation.

Tumor Implantation:

Cells in logarithmic growth phase were harvested and washed in 50 ml falcon tubes at 1200 rpm for 5 minutes, once in growth media and then twice in cold sterile PBS. Cells were resuspended in PBS at a concentration of $5\times10^6$ per ml, placed on ice, and injected in mice. Cancer cells were injected intravenously in 200 µl through the caudal vein. Nalm6 cells endogenously express CD22 and thus, can be used to test the efficacy of CD22-directed CAR T cells in vivo. This model grows well when implanted intravenously in mice, which can be imaged for tumor burden measurements. Upon injection of $1\times10^6$ cancer cells, the tumors establish and can be accurately measured within 3 days. Baseline measurements are $4-6\times10^5$ photons/second (p/s). Within 7 days the mean bioluminescence measurement is $2-4\times10^6$ p/s and untreated tumors reach endpoint measurement ($2-3\times10^9$) by 20-30 days. Anti-tumor activities of therapeutic agents are often tested once tumors are fully engrafted. Thus, there is a large window with these models during which the anti-tumor activity of CAR T cells can be observed.

CAR T Cell Dosing:

Mice were dosed 7 days after tumor implantation, with $1\times10^6$ CAR T cells for the treatment of Nalm6. Cells were partially thawed in a 37° C. water bath and then completely thawed by the addition of 1 ml of warmed growth media. The thawed cells were transferred to a 50 ml falcon tube and adjusted to a final volume of 12 ml with growth media. The cells were washed twice and spun at 300 g for 10 minutes and then counted by hemocytometer. T cells were then resuspended at respective concentrations in cold PBS and kept on ice until the mice were dosed. The CARTs were injected intravenously via the tail vein in 200 al, for a dose of $1\times10^6$ CAR T cells. 5 mice per group were either treated with 200 µl of PBS alone (PBS), EGFRvIII-transduced T cells, as well as the novel CD22-65_Zwt, CD22-65s_Zwt, CD22-65ss_Zwt, CD22-65sLH_Zwt, CD22-65sKD_Zwt, and CD22-m971s_Zmut CAR T cells. All cells were prepared from the same donor in parallel.

Animal Monitoring:

The health status of the mice was monitored daily, including twice weekly body weight measurements. The percent change in body weight was calculated as (BWcurrent−BWinitial)/(BWinitial)×100%. Tumors were monitored 2 times weekly by imaging the mice.

The anti-tumor activity of CD22 CAR T cells was assessed in a B-cell acute lymphoblastic leukemia xenograft model. Following tumor cell implantation on day 0, tumor bearing mice were randomized into treatment groups and CAR T cells were administered intravenously via the lateral tail vein on day 7 after tumor implantation. Tumor growth and animal health were monitored until animals achieved endpoint.

Figure 26:
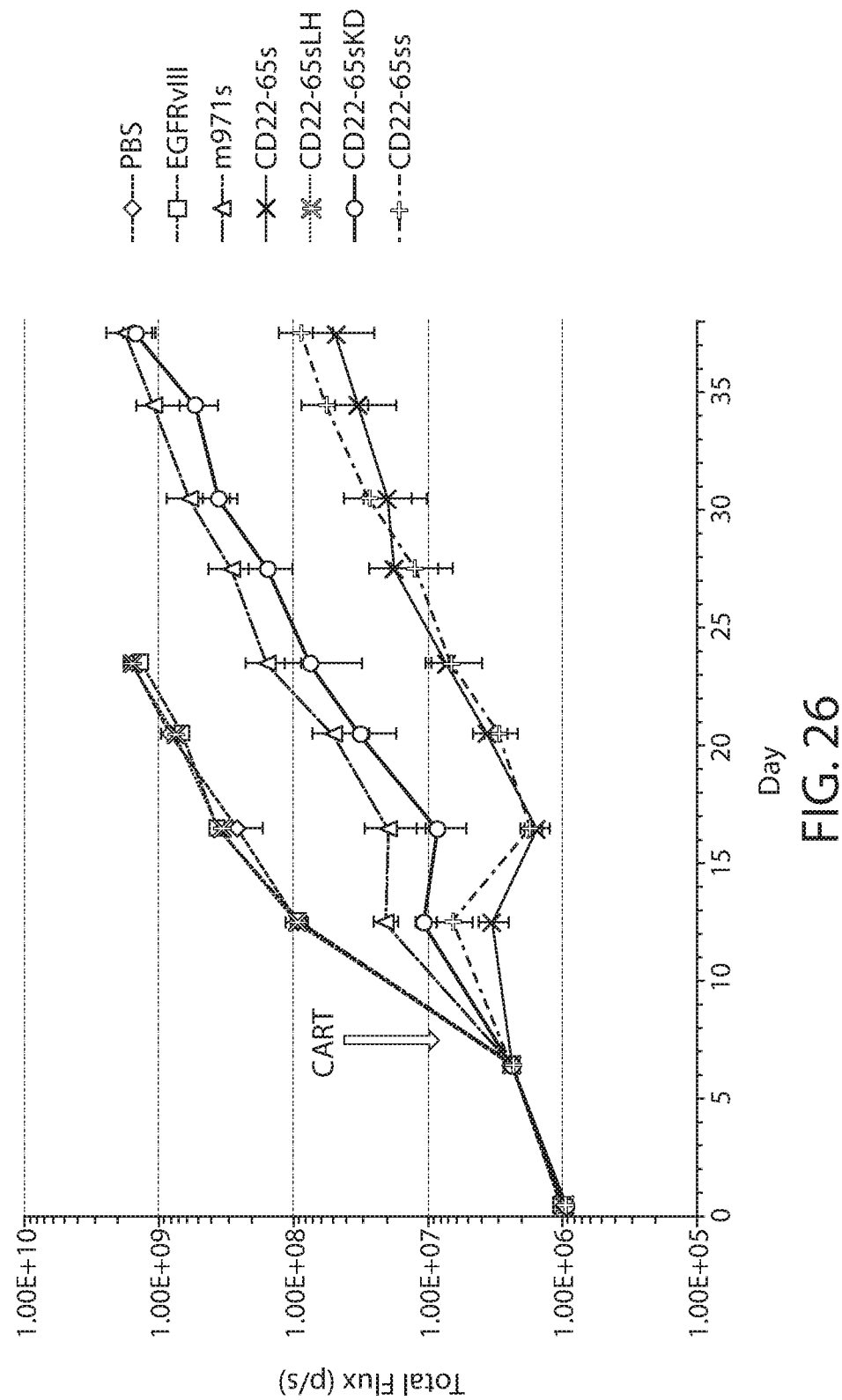
FIG. 26 is a graph showing tumor regression as indicated from mean bioluminescence in Nalm6 mice treated with CD22-65_Zwt, CD22-65s_Zwt, CD22-65ss_Zwt, CD22-65sKD_Zwt, and CD22-m971s_Zmut. Mice also received PBS or EGFRvIII T cells.

In this Nalm6 model, mice which received PBS or EGFRvIII T cells were euthanized on day 23, when tumors were causing decreased hind leg mobility. All other groups were euthanized on day 37. The mean bioluminescence for all treatment groups was then determined (FIG. 26). The PBS treatment group, which did not receive any T cells, demonstrates baseline Nalm6 tumor growth kinetics in intravenously injected NSG mice. The EGFRvIII treatment group received mock-transduced T cells and served as a T cell control to show the non-specific response of human donor T cells in this model. Both the PBS and UTD treatment groups demonstrated continuous tumor progression throughout this study. CD22-65_Zwt, CD22-65s_Zwt, CD22-65ss_Zwt, CD22-65sKD_Zwt, and CD22-m971s_Zmut CAR T cells all showed significantly slower tumor growth. CD22-65s_Zwt, CD22-65ss_Zwt showed the strongest response.

These data demonstrate that the CD22-specific CAR T cells CD22-65s_Zwt and CD22-65ss_Zwt are capable of strongly inhibiting the growth of NALM6 cancer at a low dose of $1\times10^6$ CAR T cells. The efficacy was superior to the control m971 CAR.

Example 13: Generation, Expression, and Antigen Activation of CARTs Including Tandem Anti-CD19 and Anti-CD22 scFVs To test whether a single CART cell functionalized with two distinct scFVs can be activated by either of the antigens that the CART recognizes, CARTs comprising two distinct scFVs linked together were generated with scFVs targeting CD19 and CD22 (Tables 15 and 17 and FIG. 27). These constructs differ in the position of the anti-CD19 recognition moiety relative to the T cell membrane (proximal or distal: closer or distant from the T cell membrane, respectively).

The generated constructs explore two different linkers connecting the two scFVs: LAEAAAK (SEQ ID NO: 1091) and GGGGS (SEQ ID NO: 1083). The LAEAAAK (SEQ ID NO: 1091) is a more rigid linker, while the GGGGS linker (SEQ ID NO: 1083) is a more flexible linker. The impact of the orientation of the light (L) and heavy (H) chains within the anti-CD22 scFV activation was also investigated. The anti-CD19 scFV was oriented as L/H (in a N- to C-terminus orientation) in all of the constructs. Two linkers connecting the H and L chains within the anti-CD22 scFV: GGGGSGGGGSGGGGS (SEQ ID NO: 1084) and GGGGS (SEQ ID NO: 1083) were also explored (annotated as "sh" in Tables 17 and 18). Control constructs engineered with the individual scFVs (anti-CD19 or anti-CD22) were also generated (Table 18).

TABLE 17

Constructs generated in the context of a single CART targeting CD22 and CD19. (Table discloses SEQ ID NOS 1091, 1083, 1091, 1083, 1091, 1083, 1091 and 1083, respectively, in order of appearance)

| Distal | Linker | Proximal | H/L | L/H |
|---|---|---|---|---|
| αCD19 | LAEA$_3$K | αCD22 | CG#c171 | CG#c177 |
| αCD19 | G$_4$S | αCD22 | CG#c172 | CG#c178 |
| αCD19 | LAEA$_3$K | αCD22$_{sh}$ | CG#c173 | CG#c179 |
| αCD19 | G$_4$S | αCD22$_{sh}$ | CG#c174 | CG#c180 |
| αCD22 | LAEA$_3$K | αCD19 | CG#c181 | CG#c185 |
| αCD22 | G$_4$S | αCD19 | CG#c182 | CG#c186 |
| αCD22$_{sh}$ | LAEA$_3$K | αCD19 | CG#c183 | CG#c187 |
| αCD22$_{sh}$ | G$_4$S | αCD19 | CG#c184 | CG#c188 |

TABLE 18

CAR construct controls generated to target CD19 or CD20.

| | H/L | L/H |
|---|---|---|
| αCD22 | CAR22-65 | CG#c175 |
| αCD22$_{sh}$ | CG#c170 | CG#c176 |
| αCD19 | | CAR19 |

Evaluation of CAR Expression:

The sequences encoding the constructs listed in Tables 17 and 18 were cloned into a lentiviral backbone vector. All of the constructs comprised the leader sequence of the human CD8alpha at their N-terminus, which is expected to be cleaved co-translationally and excluded in the final protein product. Transgene expression was driven by the EF1alpha promoter. The resulting DNAs were used to transfect HEK-293 cells for viral production. Exemplary viral titers are shown in Table 19. Viral titers were determined based on surface expression of the various constructs in SupT1 cells, by FACS using two distinct staining reagents. An anti-idiotype antibody recognizing the scFv directed to CD19 and CD22-FC for staining the scFV directed to CD22 were used. Staining was performed individually.

TABLE 19 viral titers obtained for some constructs tested in the context of CD19- and CD22- targeting

| Sample | CD19 anti-ID Titer (TU/ml) | CD22-Fc (TU/ml) |
|---|---|---|
| c171 | 2.18E+06 | 2.51E+06 |
| c172 | 3.29E+05 | 9.43E+05 |
| c173 | 2.78E+05 | 7.34E+05 |
| c174 | 8.82E+05 | 1.95E+06 |
| c181 | 1.99E+06 | 2.54E+06 |
| c182 | 1.01E+06 | 2.53E+06 |
| c183 | 2.26E+06 | 1.85E+06 |
| c184 | 2.24E+06 | 2.81E+06 |
| c185 | 1.80E+07 | 1.99E+07 |
| c186 | 9.49E+06 | 1.92E+07 |
| c187 | 1.64E+07 | 1.76E+07 |
| c188 | 3.44E+07 | 4.84E+07 |

TABLE 19-continued viral titers obtained for some constructs tested in the context of CD19- and CD22- targeting

| Sample | CD19 anti-ID Titer (TU/ml) | CD22-Fc (TU/ml) |
|---|---|---|
| c170 | 0.00E+00 | 6.18E+07 |
| c175 | 0.00E+00 | 2.73E+06 |
| c176 | 0.00E+00 | 7.84E+06 |
| CAR22-65 Long | 0.00E+00 | 2.60E+07 |
| CAR19 | 8.16E+07 | 0.00E+00 |

Figure 28:
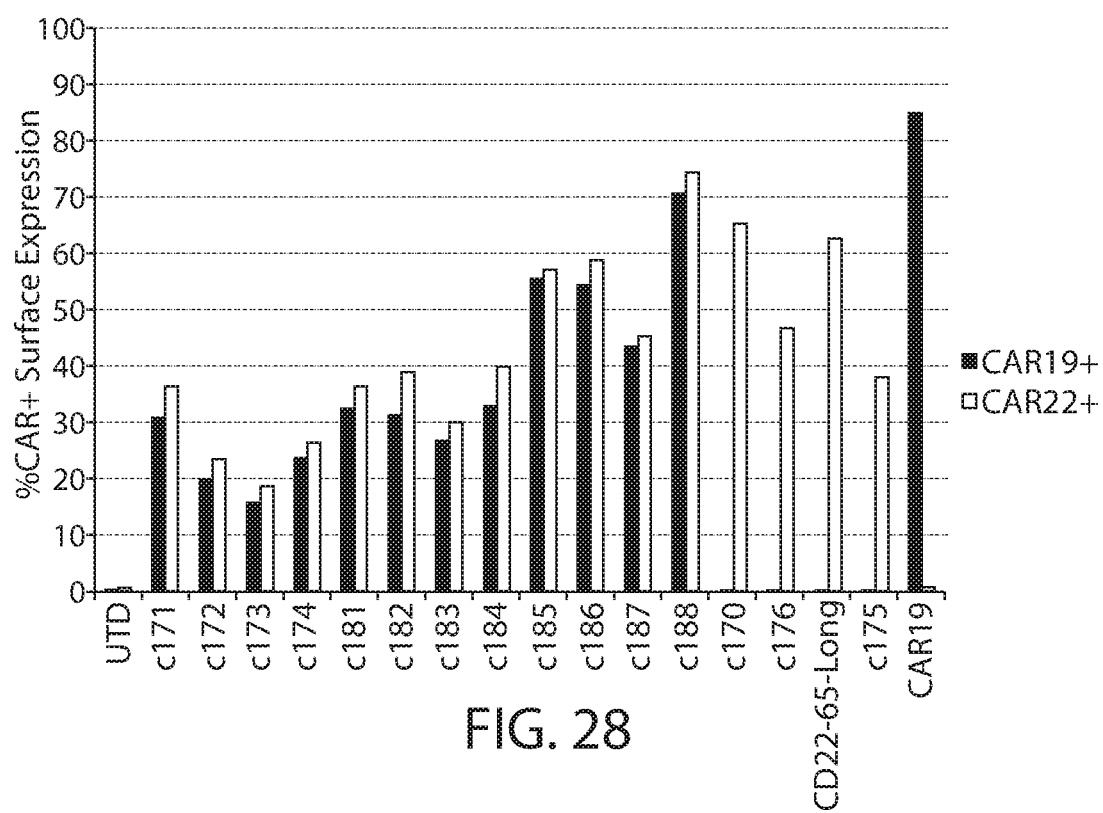
FIG. 28 is a graph showing CAR % based on FACS surface staining of JNL cells using a reagent recognizing the scFV directed to CD19 (dark bars) or CD22 (gray bars). A multiplicity of infection of 1, 0.8, and 2.2 was used in c171, c172, and c173, respectively.

For each construct, the viral titers obtained with the two staining reagents were averaged and the viruses were evaluated for their ability to transduce JNL cells. The Jurkat cells were previously transduced with a NFAT-Luciferase reporter construct. A multiplicity of infection of 3 was used. The percent cells positive for CAR in JNLs following transduction with the indicated constructs was determined (FIG. 28). CAR expression was determined 7 days post-transduction by FACS using the same staining reagents for checking expression of CAR in infected SupT1 cells. Staining was performed individually with no co-addition of the two reagents to avoid hindrance.

These data show that the scFVs across the different constructs were detected at the cell surface, indicating expression and trafficking to the cell surface for the constructs targeting both CD19 and CD22. Use of a staining reagent that is the antigen itself (CD22-Fc) indicates that the scFV directed to CD22 acquired a correctly folded structure, which is compatible with recognition of the antigen within the CD22 protein. This result was observed whether the anti-CD22 scFV arm was engineered upstream or downstream of the antiCD19 scFV arm.

Figure 29:
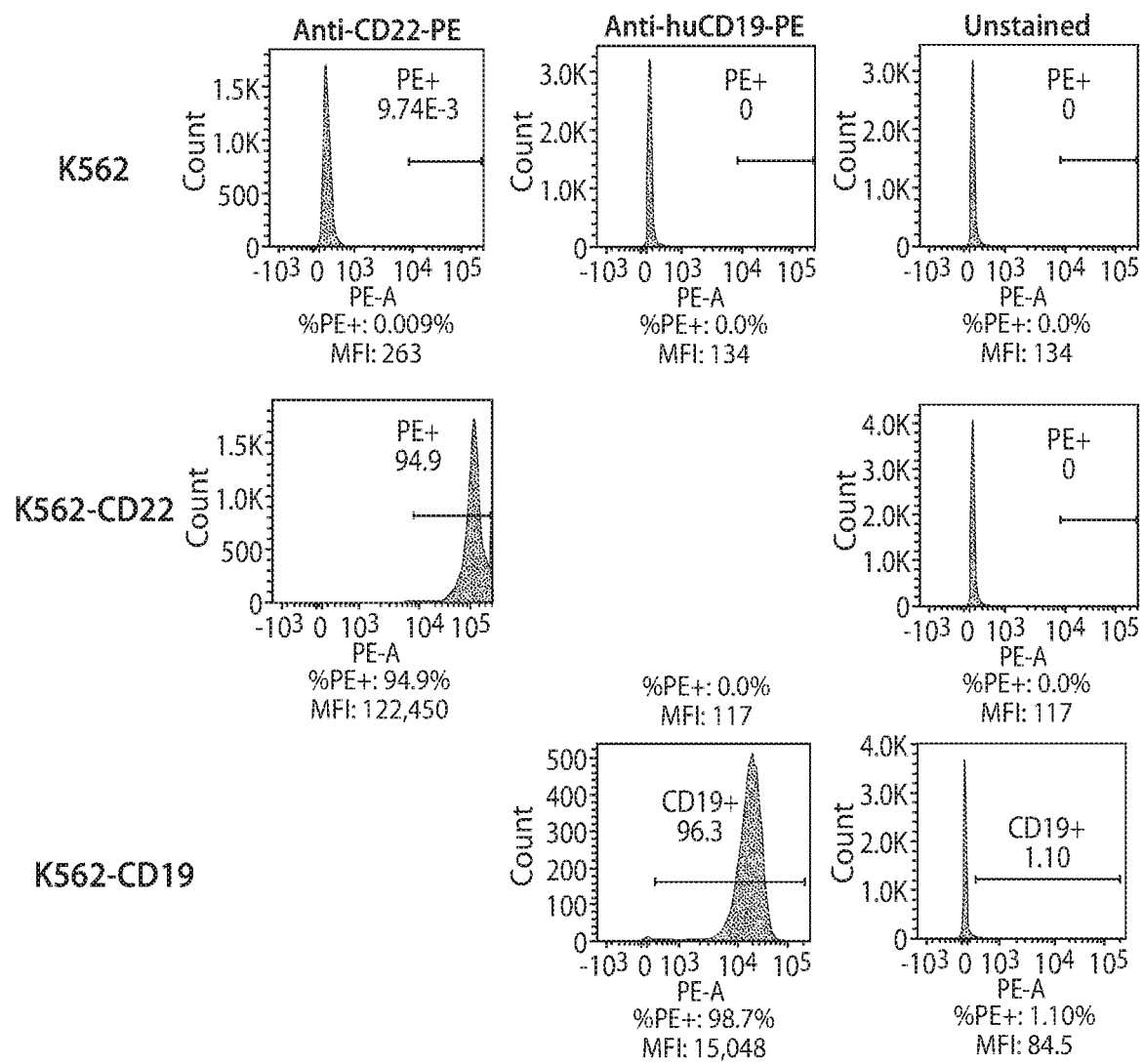
FIG. 29 is a graph showing the different target cell lines used to assess activation of JNLs functionalized with the various CARs shown on Table 1 are stained for CD19 and CD22, using FACS. Both staining reagents are labeled with phycoerythrin (PE). The percentage of positive cells as well as the MFI (mean fluorescence intensity) for the protein being detected at the surface is shown (%).

Evaluation of CAR Activation:

To evaluate whether a CAR comprising two distinct scFVs can be activated by either of the targeted antigens, we co-cultured the untransduced (UTD) and transduced JNLs with target cell lines expressing either CD19 (K562-CD19) or CD22 (K562-CD22). When the CAR recognized the CD19 or CD22 antigen, CAR engagement resulted in downstream NFAT activation. The NFAT-luciferase reporter in the JNL cells provided a measure to read out CAR activation. The expression levels of CD19 and CD22 in the different target cell lines is shown (FIG. 29).

Figure 30:
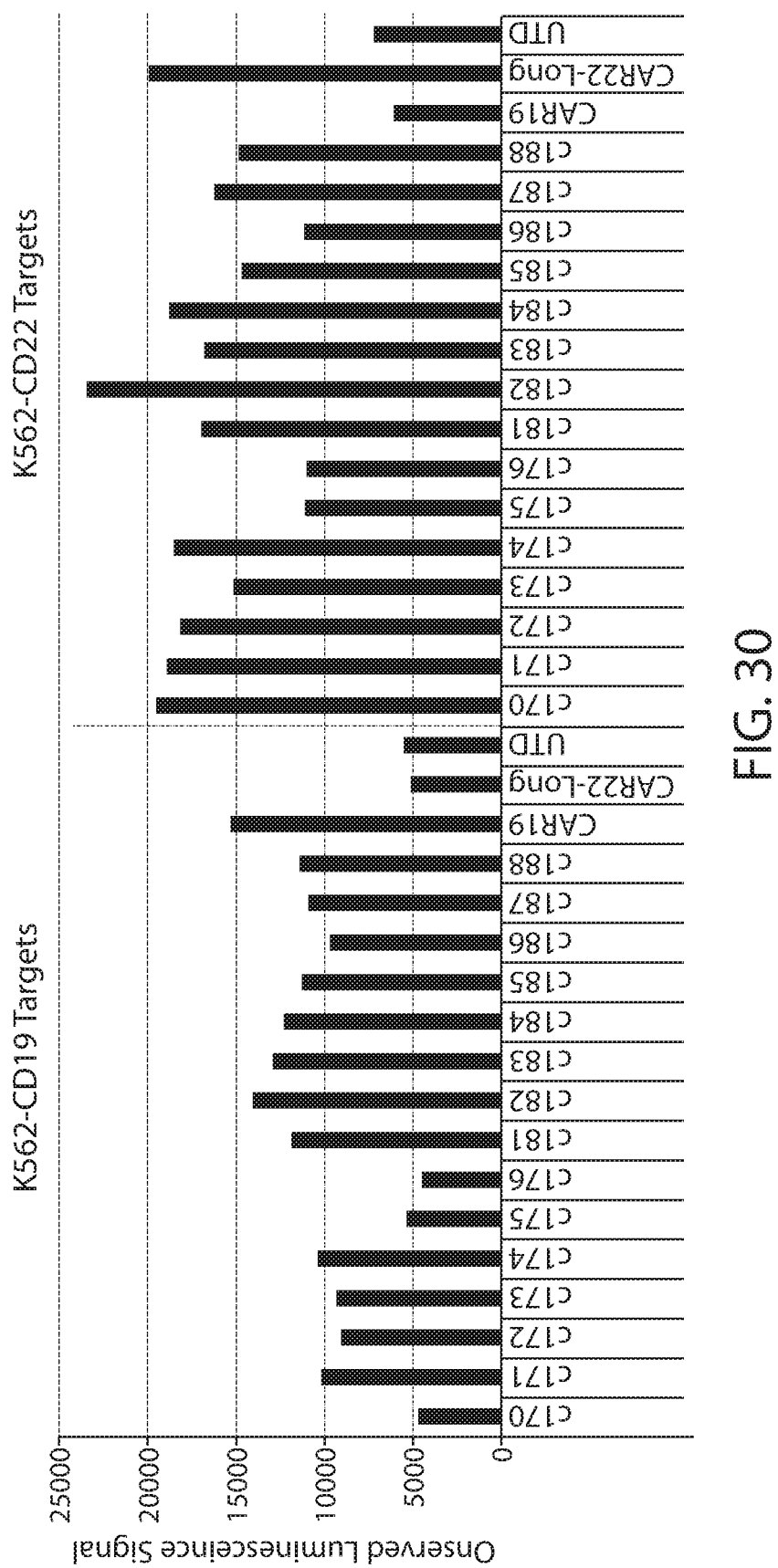
FIG. 30 is a graph showing the untransduced (UTD) and transduced JNLs incubated with targeted cell lines expressing either CD19 or CD22, at a 1:1 cell ratio, for 20 hrs. The level of NFAT-induced luciferase (arbitrary units shown on the y-axis) is a measure of CAR activity.

The level of NFAT-induced luciferase as a measure of CAR activity is shown (FIG. 30). The number of JNL cells added to the assay was normalized to the lowest expression of CAR, based on the data shown in FIG. 28. All of the constructs comprising two scFVs, one against CD19 and another against CD22, were activated by both targets, regardless of the orientation of the scFV relative to the T cell membrane. The monoCARs were activated only by the antigen that its scFV recognizes (CD19 or CD22).

EQUIVALENTS

The disclosures of each and every patent, patent application, and publication cited herein are hereby incorporated herein by reference in their entirety. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (1103 sequences)

SEQ ID NO: 1 - protein, 5 aa, Artificial Sequence
  Description of Artificial Sequence: Synthetic peptide
NYWMH

SEQ ID NO: 2 - protein, 17 aa, Artificial Sequence
  Description of Artificial Sequence: Synthetic peptide
FITPTTGYPEYNQKFKD

SEQ ID NO: 3 - protein, 13 aa, Artificial Sequence
  Description of Artificial Sequence: Synthetic peptide
RKVGKGVYYALDY

SEQ ID NO: 4 - protein, 7 aa, Artificial Sequence
  Description of Artificial Sequence: Synthetic peptide
GYTFTNY

SEQ ID NO: 5 - protein, 6 aa, Artificial Sequence
  Description of Artificial Sequence: Synthetic peptide
TPTTGY

SEQ ID NO: 6 - protein, 13 aa, Artificial Sequence
  Description of Artificial Sequence: Synthetic peptide
RKVGKGVYYALDY

SEQ ID NO: 7 - protein, 8 aa, Artificial Sequence
  Description of Artificial Sequence: Synthetic peptide
GYTFTNYW

SEQ ID NO: 8 - protein, 8 aa, Artificial Sequence
  Description of Artificial Sequence: Synthetic peptide
ITPTTGYP

SEQ ID NO: 9 - protein, 15 aa, Artificial Sequence
  Description of Artificial Sequence: Synthetic peptide
ARRKVGKGVYYALDY

SEQ ID NO: 10 - protein, 122 aa, Artificial Sequence
  Description of Artificial Sequence: Synthetic polypeptide
QVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSS

SEQ ID NO: 11 - DNA, 366 bp, Artificial Sequence
  Description of Artificial Sequence: Synthetic polynucleotide
caagtgcaactcgtccagtccggtgcagaagtcaagaaaccaggcgcatccgtgaaagtctcctgcaaagcctccggctacacattcactaactattggatgcattgggtgcgccaggccccgggacaggggctggagtggatggggttcattacccctaccaccggctaccctgagtacaaccagaagttcaaggatagggtcaccatgaccgctgacaagtccacctccaccgcgtacatggaactgtcatcgctccggtccgaggataccgcggtgtactactgcgcccggagaaaagtcggaaagggagtgtattacgccttggactactggggacaggggactaccgtgaccgtgtcgagc

SEQ ID NO: 12 - protein, 11 aa, Artificial Sequence
  Description of Artificial Sequence: Synthetic peptide
RASGNIHNYLA

SEQ ID NO: 13 - protein, 7 aa, Artificial Sequence
  Description of Artificial Sequence: Synthetic peptide
NTKTLAD

SEQ ID NO: 14 - protein, 9 aa, Artificial Sequence
  Description of Artificial Sequence: Synthetic peptide
QHFWSSPWT

SEQ ID NO: 15 - protein, 7 aa, Artificial Sequence
  Description of Artificial Sequence: Synthetic peptide
SGNIHNY

SEQ ID NO: 16 - protein, 3 aa, Artificial Sequence
  Description of Artificial Sequence: Synthetic peptide
NTK

SEQ ID NO: 17 - protein, 6 aa, Artificial Sequence
  Description of Artificial Sequence: Synthetic peptide
FWSSPW

SEQ ID NO: 18 - protein, 6 aa, Artificial Sequence
  Description of Artificial Sequence: Synthetic peptide
GNIHNY

SEQ ID NO: 19 - protein, 3 aa, Artificial Sequence
  Description of Artificial Sequence: Synthetic peptide
NTK

SEQ ID NO: 20 - protein, 9 aa, Artificial Sequence
  Description of Artificial Sequence: Synthetic peptide
QHFWSSPWT

SEQ ID NO: 21 - protein, 107 aa, Artificial Sequence
  Description of Artificial Sequence: Synthetic polypeptide
DIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIK

SEQ ID NO: 22 - DNA, 321 bp, Artificial Sequence
  Description of Artificial Sequence: Synthetic polynucleotide
gacatccagatgacccagtccccgtcaagccttagcgcctccgtgggcgaccgcgtgaccattacttgtcgggcgtcgggaaacatccacaactacctcgcctggtaccagcagaagccgggaaaggtccccaagctgctgatctacaataccaagactctggccgacggagtgccttcccgcttttccggttcgggaagcgggactgactacaccctgactatctcctcgctgcaacccgaagatgtggctacgtactactgccagcacttctggtcctctccctggaccttcggcggtggcactaaggtcgagattaag

SEQ ID NO: 23 - protein, 20 aa, Artificial Sequence
  Description of Artificial Sequence: Synthetic peptide
GGGGSGGGGSGGGGSGGGGS

SEQ ID NO: 24 - protein, 249 aa, Artificial Sequence
  Description of Artificial Sequence: Synthetic polypeptide
QVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSSGGGGSGGGGSGGGGSGGGGSDIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIK

SEQ ID NO: 25 - DNA, 747 bp, Artificial Sequence
  Description of Artificial Sequence: Synthetic polynucleotide
caagtgcaactcgtccagtccggtgcagaagtcaagaaaccaggcgcatccgtgaaagtctcctgcaaagcctccggctacacattcactaactattggatgcattgggtgcgccaggccccgggacaggggctggagtggatggggttcattacccctaccaccggctaccctgagtacaaccagaagttcaaggatagggtcaccatgaccgctgacaagtccacctccaccgcgtacatggaactgtcatcgctccggtccgaggataccgcggtgtactactgcgcccggagaaaagtcggaaagggagtgtattacgccttggactactggggacaggggactaccgtgaccgtgtcgagcggtggaggcggctccggcggaggaggaagcgggggaggcggttcagggggcggaggaagcgacatccagatgacccagtccccgtcaagccttagcgcctccgtgggcgaccgcgtgaccattacttgtcgggcgtcgggaaacatccacaactacctcgcctggtaccagcagaagccgggaaaggtccccaagctgctgatctacaataccaagactctggccgacggagtgccttcccgcttttccggttcgggaagcgggactgactacaccctgactatctcctcgctgcaacccgaagatgtggctacgtactactgccagcacttctggtcctctccctggaccttcggcggtggcactaaggtcgagattaag

SEQ ID NO: 26 - protein, 493 aa, Artificial Sequence
  Description of Artificial Sequence: Synthetic polypeptide
MALPVTALLLPLALLLHAARPQVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSSGGGGSGGGGSGGGGSGGGGSDIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 27 - DNA, 1479 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaaaccaggcgcatccgtgaaagtctcctgcaaagcctccggctacacattcactaactattggatgcattgggtgcgccaggccccgggacaggggctggagtggatggggttcattacccctaccaccggctaccctgagtacaaccagaagttcaaggatagggtcaccatgaccgctgacaagtccacctccaccgcgtacatggaactgtcatcgctccggtccgaggataccgcggtgtactactgcgcccggagaaaagtcggaaagggagtgtattacgccttggactactggggacaggggactaccgtgaccgtgtcgagcggtggaggcggctccggcggaggaggaagcgggggaggcggttcagggggcggaggaagcgacatccagatgacccagtccccgtcaagccttagcgcctccgtgggcgaccgcgtgaccattacttgtcgggcgtcgggaaacatccacaactacctcgcctggtaccagcagaagccgggaaaggtccccaagctgctgatctacaataccaagactctggccgacggagtgccttcccgcttttccggttcgggaagcgggactgactacaccctgactatctcctcgctgcaacccgaagatgtggctacgtactactgccagcacttctggtcctctccctggaccttcggcggtggcactaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 28 - protein, 5 aa, Artificial Sequence
  Description of Artificial Sequence: Synthetic peptide
NYWMH

SEQ ID NO: 29 - protein, 17 aa, Artificial Sequence
  Description of Artificial Sequence: Synthetic peptide
FITPTTGYPEYNQKFKD

SEQ ID NO: 30 - protein, 13 aa, Artificial Sequence
  Description of Artificial Sequence: Synthetic peptide
RKVGKGVYYALDY

SEQ ID NO: 31 - protein, 7 aa, Artificial Sequence
  Description of Artificial Sequence: Synthetic peptide
GYTFTNY

SEQ ID NO: 32 - protein, 6 aa, Artificial Sequence
  Description of Artificial Sequence: Synthetic peptide
TPTTGY

SEQ ID NO: 33 - protein, 13 aa, Artificial Sequence
  Description of Artificial Sequence: Synthetic peptide
RKVGKGVYYALDY

SEQ ID NO: 34 - protein, 8 aa, Artificial Sequence
  Description of Artificial Sequence: Synthetic peptide
GYTFTNYW

SEQ ID NO: 35 - protein, 8 aa, Artificial Sequence
  Description of Artificial Sequence: Synthetic peptide
ITPTTGYP

SEQ ID NO: 36 - protein, 15 aa, Artificial Sequence
  Description of Artificial Sequence: Synthetic peptide
ARRKVGKGVYYALDY

SEQ ID NO: 37 - protein, 122 aa, Artificial Sequence
  Description of Artificial Sequence: Synthetic polypeptide
QVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSS

SEQ ID NO: 38 - DNA, 366 bp, Artificial Sequence
  Description of Artificial Sequence: Synthetic polynucleotide
caagtccaactcgtccaatcaggagcagaagtcaagaagcccggaagctctgtcaaagtgtcctgcaaggcctccggttacaccttcaccaactattggatgcactgggtcagacaggccccgggacagggcttggaatggatgggtttcatcactccaaccaccggttacccggagtacaaccagaagtttaaggaccgcgtgaccattactgccgacaagtccacgagcaccgcttacatggaacttagcagcctgcggtccgaggacactgccgtgtattactgcgcgcggaggaaggtcggaaagggagtgtactacgcactggactactggggccagggaaccaccgtgactgtgtcctcc

SEQ ID NO: 39 - protein, 11 aa, Artificial Sequence
  Description of Artificial Sequence: Synthetic peptide
RASGNIHNYLA

SEQ ID NO: 40 - protein, 7 aa, Artificial Sequence
  Description of Artificial Sequence: Synthetic peptide
NTKTLAD

SEQ ID NO: 41 - protein, 9 aa, Artificial Sequence
  Description of Artificial Sequence: Synthetic peptide
QHFWSSPWT

SEQ ID NO: 42 - protein, 7 aa, Artificial Sequence
  Description of Artificial Sequence: Synthetic peptide
SGNIHNY

SEQ ID NO: 43 - protein, 3 aa, Artificial Sequence
  Description of Artificial Sequence: Synthetic peptide
NTK

SEQ ID NO: 44 - protein, 6 aa, Artificial Sequence
  Description of Artificial Sequence: Synthetic peptide
FWSSPW

SEQ ID NO: 45 - protein, 6 aa, Artificial Sequence
  Description of Artificial Sequence: Synthetic peptide
GNIHNY

SEQ ID NO: 46 - protein, 3 aa, Artificial Sequence
  Description of Artificial Sequence: Synthetic peptide
NTK

SEQ ID NO: 47 - protein, 9 aa, Artificial Sequence
  Description of Artificial Sequence: Synthetic peptide
QHFWSSPWT

SEQ ID NO: 48 - protein, 107 aa, Artificial Sequence; identical to SEQ ID NO: 21
  Description of Artificial Sequence: Synthetic polypeptide

SEQ ID NO: 49 - DNA, 321 bp, Artificial Sequence
  Description of Artificial Sequence: Synthetic polynucleotide
gatattcagatgacccagtccccttcatccctgagcgcctcagtgggcgatagagtgaccatcacttgtcgcgcctcgggcaatatccacaactacctcgcctggtaccagcagaagccgggaaaagtgcctaagctgctgatctacaacactaagaccctggcggatggagtgcccagccggttctccggctccggcagcggcacagactacaccctcaccatctcctcgctgcaaccagaggacgtggctacctactactgccagcatttctggtcgtccccctggactttcggaggggggaccaaagtggagattaag

SEQ ID NO: 50 - protein, 20 aa, Artificial Sequence
  Description of Artificial Sequence: Synthetic peptide
GGGGSGGGGSGGGGSGGGGS

SEQ ID NO: 51 - protein, 249 aa, Artificial Sequence
  Description of Artificial Sequence: Synthetic polypeptide
QVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSSGGGGSGGGGSGGGGSGGGGSDIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIK

SEQ ID NO: 52 - DNA, 747 bp, Artificial Sequence
  Description of Artificial Sequence: Synthetic polynucleotide
caagtccaactcgtccaatcaggagcagaagtcaagaagcccggaagctctgtcaaagtgtcctgcaaggcctccggttacaccttcaccaactattggatgcactgggtcagacaggccccgggacagggcttggaatggatgggtttcatcactccaaccaccggttacccggagtacaaccagaagtttaaggaccgcgtgaccattactgccgacaagtccacgagcaccgcttacatggaacttagcagcctgcggtccgaggacactgccgtgtattactgcgcgcggaggaaggtcggaaagggagtgtactacgcactggactactggggccagggaaccaccgtgactgtgtcctccggtggcggagggtcgggaggggggggctcgggaggaggagggtccgggggcggtggctcagatattcagatgacccagtccccttcatccctgagcgcctcagtgggcgatagagtgaccatcacttgtcgcgcctcgggcaatatccacaactacctcgcctggtaccagcagaagccgggaaaagtgcctaagctgctgatctacaacactaagaccctggcggatggagtgcccagccggttctccggctccggcagcggcacagactacaccctcaccatctcctcgctgcaaccagaggacgtggctacctactactgccagcatttctggtcgtccccctggactttcggaggggggaccaaagtggagattaag

SEQ ID NO: 53 - protein, 493 aa, Artificial Sequence
  Description of Artificial Sequence: Synthetic polypeptide
MALPVTALLLPLALLLHAARPQVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSSGGGGSGGGGSGGGGSGGGGSDIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 54 - DNA, 1479 bp, Artificial Sequence
  Description of Artificial Sequence: Synthetic polynucleotide
atggccctccctgtcaccgccctgctgcttccgctggctcttctgctccacgccgctcggccccaagtccaactcgtccaatcaggagcagaagtcaagaagcccggaagctctgtcaaagtgtcctgcaaggcctccggttacaccttcaccaactattggatgcactgggtcagacaggccccgggacagggcttggaatggatgggtttcatcactccaaccaccggttacccggagtacaaccagaagtttaaggaccgcgtgaccattactgccgacaagtccacgagcaccgcttacatggaacttagcagcctgcggtccgaggacactgccgtgtattactgcgcgcggaggaaggtcggaaagggagtgtactacgcactggactactggggccagggaaccaccgtgactgtgtcctccggtggcggagggtcgggaggggggggctcgggaggaggagggtccgggggcggtggctcagatattcagatgacccagtccccttcatccctgagcgcctcagtgggcgatagagtgaccatcacttgtcgcgcctcgggcaatatccacaactacctcgcctggtaccagcagaagccgggaaaagtgcctaagctgctgatctacaacactaagaccctggcggatggagtgcccagccggttctccggctccggcagcggcacagactacaccctcaccatctcctcgctgcaaccagaggacgtggctacctactactgccagcatttctggtcgtccccctggactttcggaggggggaccaaagtggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 55 - protein, 5 aa, Artificial Sequence
  Description of Artificial Sequence: Synthetic peptide
NYWMH

SEQ ID NO: 56 - protein, 17 aa, Artificial Sequence
  Description of Artificial Sequence: Synthetic peptide
FITPTTGYPEYNQKFKD

SEQ ID NO: 57 - protein, 13 aa, Artificial Sequence
  Description of Artificial Sequence: Synthetic peptide
RKVGKGVYYALDY

SEQ ID NO: 58 - protein, 7 aa, Artificial Sequence
  Description of Artificial Sequence: Synthetic peptide
GYTFTNY

SEQ ID NO: 59 - protein, 6 aa, Artificial Sequence
  Description of Artificial Sequence: Synthetic peptide
TPTTGY

SEQ ID NO: 60 - protein, 13 aa, Artificial Sequence
  Description of Artificial Sequence: Synthetic peptide
RKVGKGVYYALDY

SEQ ID NO: 61 - protein, 8 aa, Artificial Sequence
  Description of Artificial Sequence: Synthetic peptide
GYTFTNYW

SEQ ID NO: 62 - protein, 8 aa, Artificial Sequence
  Description of Artificial Sequence: Synthetic peptide
ITPTTGYP

SEQ ID NO: 63 - protein, 15 aa, Artificial Sequence
  Description of Artificial Sequence: Synthetic peptide
ARRKVGKGVYYALDY

SEQ ID NO: 64 - protein, 122 aa, Artificial Sequence; identical to SEQ ID NO: 10
  Description of Artificial Sequence: Synthetic polypeptide

SEQ ID NO: 65 - DNA, 366 bp, Artificial Sequence
  Description of Artificial Sequence: Synthetic polynucleotide
caagtccaactcgtccagtccggtgcagaagtcaagaaacccggagcttccgtgaaagtgtcctgcaaagcctccggttacacctttacgaactactggatgcattgggtgcgccaggccccgggacaggggctggaatggatgggcttcattacccccaccaccggataccccgagtacaatcagaagttcaaggaccgggtcaccatgaccgccgacaagtcaacctctactgcttacatggagctgtccagcctgcggtcggaagataccgccgtgtattactgcgcgagaaggaaagtcggaaagggagtgtactatgccctggactactggggacaggggaccactgtgactgtgtcaagc

SEQ ID NO: 66 - protein, 11 aa, Artificial Sequence
  Description of Artificial Sequence: Synthetic peptide
RASGNIHNYLA

SEQ ID NO: 67 - protein, 7 aa, Artificial Sequence
  Description of Artificial Sequence: Synthetic peptide
NTKTLAD

SEQ ID NO: 68 - protein, 9 aa, Artificial Sequence
  Description of Artificial Sequence: Synthetic peptide
QHFWSSPWT

SEQ ID NO: 69 - protein, 7 aa, Artificial Sequence
  Description of Artificial Sequence: Synthetic peptide
SGNIHNY

SEQ ID NO: 70 - protein, 3 aa, Artificial Sequence
  Description of Artificial Sequence: Synthetic peptide
NTK

SEQ ID NO: 71 - protein, 6 aa, Artificial Sequence
  Description of Artificial Sequence: Synthetic peptide
FWSSPW

SEQ ID NO: 72 - protein, 6 aa, Artificial Sequence
  Description of Artificial Sequence: Synthetic peptide
GNIHNY

SEQ ID NO: 73 - protein, 3 aa, Artificial Sequence
  Description of Artificial Sequence: Synthetic peptide
NTK

SEQ ID NO: 74 - protein, 9 aa, Artificial Sequence
  Description of Artificial Sequence: Synthetic peptide
QHFWSSPWT

SEQ ID NO: 75 - protein, 107 aa, Artificial Sequence
  Description of Artificial Sequence: Synthetic polypeptide
AIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIK

SEQ ID NO: 76 - DNA, 321 bp, Artificial Sequence
  Description of Artificial Sequence: Synthetic polynucleotide
gcgatccgcatgacccagagcccgttctccctgtccgcgtccgtgggggaccgcgtgactatcacgtgtcgggcctccgggaacatccacaactacctcgcatggtaccagcagaagccggccaaggcccctaagttgttcatctacaacaccaagactcttgccgacggagtgccgtcccggtttagcggaagcggttccggcaccgactacaccctgactatctcgagcctgcaaccagaagatttcgccacttactactgccagcacttctggtcgtccccttggacattcggcggcggcaccaaggtcgagattaag

SEQ ID NO: 77 - protein, 20 aa, Artificial Sequence
  Description of Artificial Sequence: Synthetic peptide
GGGGSGGGGSGGGGSGGGGS

SEQ ID NO: 78 - protein, 249 aa, Artificial Sequence
  Description of Artificial Sequence: Synthetic polypeptide
QVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSSGGGGSGGGGSGGGGSGGGGSAIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIK

SEQ ID NO: 79 - DNA, 747 bp, Artificial Sequence
  Description of Artificial Sequence: Synthetic polynucleotide
caagtccaactcgtccagtccggtgcagaagtcaagaaacccggagcttccgtgaaagtgtcctgcaaagcctccggttacacctttacgaactactggatgcattgggtgcgccaggccccgggacaggggctggaatggatgggcttcattacccccaccaccggataccccgagtacaatcagaagttcaaggaccgggtcaccatgaccgccgacaagtcaacctctactgcttacatggagctgtccagcctgcggtcggaagataccgccgtgtattactgcgcgagaaggaaagtcggaaagggagtgtactatgccctggactactggggacaggggaccactgtgactgtgtcaagcggaggcggaggctcggggggcggaggttcgggcggaggaggatcagggggcggcggttccgcgatccgcatgacccagagcccgttctccctgtccgcgtccgtgggggaccgcgtgactatcacgtgtcgggcctccgggaacatccacaactacctcgcatggtaccagcagaagccggccaaggcccctaagttgttcatctacaacaccaagactcttgccgacggagtgccgtcccggtttagcggaagcggttccggcaccgactacaccctgactatctcgagcctgcaaccagaagatttcgccacttactactgccagcacttctggtcgtccccttggacattcggcggcggcaccaaggtcgagattaag

SEQ ID NO: 80 - protein, 493 aa, Artificial Sequence
  Description of Artificial Sequence: Synthetic polypeptide
MALPVTALLLPLALLLHAARPQVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSSGGGGSGGGGSGGGGSGGGGSAIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 81 - DNA, 1479 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaacccggagcttccgtgaaagtgtcctgcaaagcctccggttacacctttacgaactactggatgcattgggtgcgccaggccccgggacaggggctggaatggatgggcttcattacccccaccaccggataccccgagtacaatcagaagttcaaggaccgggtcaccatgaccgccgacaagtcaacctctactgcttacatggagctgtccagcctgcggtcggaagataccgccgtgtattactgcgcgagaaggaaagtcggaaagggagtgtactatgccctggactactggggacaggggaccactgtgactgtgtcaagcggaggcggaggctcggggggcggaggttcgggcggaggaggatcagggggcggcggttccgcgatccgcatgacccagagcccgttctccctgtccgcgtccgtgggggaccgcgtgactatcacgtgtcgggcctccgggaacatccacaactacctcgcatggtaccagcagaagccggccaaggcccctaagttgttcatctacaacaccaagactcttgccgacggagtgccgtcccggtttagcggaagcggttccggcaccgactacaccctgactatctcgagcctgcaaccagaagatttcgccacttactactgccagcacttctggtcgtccccttggacattcggcggcggcaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 82 - protein, 5 aa, Artificial Sequence
  Description of Artificial Sequence: Synthetic peptide
NYWMH

SEQ ID NO: 83 - protein, 17 aa, Artificial Sequence
  Description of Artificial Sequence: Synthetic peptide
FITPTTGYPEYNQKFKD

SEQ ID NO: 84 - protein, 13 aa, Artificial Sequence
  Description of Artificial Sequence: Synthetic peptide
RKVGKGVYYALDY

SEQ ID NO: 85 - protein, 7 aa, Artificial Sequence
  Description of Artificial Sequence: Synthetic peptide
GYTFTNY

SEQ ID NO: 86 - protein, 6 aa, Artificial Sequence
  Description of Artificial Sequence: Synthetic peptide
TPTTGY

SEQ ID NO: 87 - protein, 13 aa, Artificial Sequence
  Description of Artificial Sequence: Synthetic peptide
RKVGKGVYYALDY

SEQ ID NO: 88 - protein, 8 aa, Artificial Sequence
  Description of Artificial Sequence: Synthetic peptide
GYTFTNYW

SEQ ID NO: 89 - protein, 8 aa, Artificial Sequence
  Description of Artificial Sequence: Synthetic peptide
ITPTTGYP

SEQ ID NO: 90 - protein, 15 aa, Artificial Sequence
  Description of Artificial Sequence: Synthetic peptide
ARRKVGKGVYYALDY

SEQ ID NO: 91 - protein, 122 aa, Artificial Sequence; identical to SEQ ID NO: 37
  Description of Artificial Sequence: Synthetic polypeptide

SEQ ID NO: 92 - DNA, 366 bp, Artificial Sequence
  Description of Artificial Sequence: Synthetic polynucleotide
caagtccaactcgtccaaagcggtgcagaagtcaagaagcccggttcctccgtgaaagtgtcctgcaaagcctcgggctacaccttcactaattactggatgcattgggtccgccaggcgcccggacagggattggaatggatggggttcatcacgccgaccaccggatacccggagtacaaccagaagttcaaggacagagtgaccattaccgccgataagtccacctccaccgcttacatggagctctcctcactgcggtccgaagatacagccgtgtactattgtgctcgccggaaagtcggaaagggagtgtactacgccctggactattggggccagggcaccaccgtgaccgtgtcctcg

SEQ ID NO: 93 - protein, 11 aa, Artificial Sequence
  Description of Artificial Sequence: Synthetic peptide
RASGNIHNYLA

SEQ ID NO: 94 - protein, 7 aa, Artificial Sequence
  Description of Artificial Sequence: Synthetic peptide
NTKTLAD

SEQ ID NO: 95 - protein, 9 aa, Artificial Sequence
  Description of Artificial Sequence: Synthetic peptide
QHFWSSPWT

SEQ ID NO: 96 - protein, 7 aa, Artificial Sequence
  Description of Artificial Sequence: Synthetic peptide
SGNIHNY

SEQ ID NO: 97 - protein, 3 aa, Artificial Sequence
  Description of Artificial Sequence: Synthetic peptide
NTK

SEQ ID NO: 98 - protein, 6 aa, Artificial Sequence
  Description of Artificial Sequence: Synthetic peptide
FWSSPW

SEQ ID NO: 99 - protein, 6 aa, Artificial Sequence
  Description of Artificial Sequence: Synthetic peptide
GNIHNY

SEQ ID NO: 100 - protein, 3 aa, Artificial Sequence
  Description of Artificial Sequence: Synthetic peptide
NTK

SEQ ID NO: 101 - protein, 9 aa, Artificial Sequence
  Description of Artificial Sequence: Synthetic peptide
QHFWSSPWT

SEQ ID NO: 102 - protein, 107 aa, Artificial Sequence; identical to SEQ ID NO: 75
  Description of Artificial Sequence: Synthetic polypeptide

SEQ ID NO: 103 - DNA, 321 bp, Artificial Sequence
  Description of Artificial Sequence: Synthetic polynucleotide
gccattaggatgactcagtcccctttctccctctccgcgagcgtgggcgaccgcgtgacgatcacttgccgggcctcggggaacattcacaactacctggcctggtaccagcagaagccggccaaggcccctaagctgttcatctacaacaccaagacccttgcggacggagtgccatcgagattttccggctcgggctctgggaccgattacactctgactatctcaagcctgcaacctgaggacttcgccacttactactgccagcacttctggagcagcccctggactttcggtggcgggaccaaggtcgaaatcaag

SEQ ID NO: 104 - protein, 20 aa, Artificial Sequence
  Description of Artificial Sequence: Synthetic peptide
GGGGSGGGGSGGGGSGGGGS

SEQ ID NO: 105 - protein, 249 aa, Artificial Sequence
  Description of Artificial Sequence: Synthetic polypeptide
QVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSSGGGGSGGGGSGGGGSGGGGSAIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIK

SEQ ID NO: 106 - DNA, 747 bp, Artificial Sequence
  Description of Artificial Sequence: Synthetic polynucleotide
caagtccaactcgtccaaagcggtgcagaagtcaagaagcccggttcctccgtgaaagtgtcctgcaaagcctcgggctacaccttcactaattactggatgcattgggtccgccaggcgcccggacagggattggaatggatggggttcatcacgccgaccaccggatacccggagtacaaccagaagttcaaggacagagtgaccattaccgccgataagtccacctccaccgcttacatggagctctcctcactgcggtccgaagatacagccgtgtactattgtgctcgccggaaagtcggaaagggagtgtactacgccctggactattggggccagggcaccaccgtgaccgtgtcctcgggaggagggggttcgggcggaggcggctccggtggaggcggaagcggagggggcggatcagccattaggatgactcagtcccctttctccctctccgcgagcgtgggcgaccgcgtgacgatcacttgccgggcctcggggaacattcacaactacctggcctggtaccagcagaagccggccaaggcccctaagctgttcatctacaacaccaagacccttgcggacggagtgccatcgagattttccggctcgggctctgggaccgattacactctgactatctcaagcctgcaacctgaggacttcgccacttactactgccagcacttctggagcagcccctggactttcggtggcgggaccaaggtcgaaatcaag

SEQ ID NO: 107 - protein, 493 aa, Artificial Sequence
  Description of Artificial Sequence: Synthetic polypeptide
MALPVTALLLPLALLLHAARPQVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSSGGGGSGGGGSGGGGSGGGGSAIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 108 - DNA, 1479 bp, Artificial Sequence
  Description of Artificial Sequence: Synthetic polynucleotide
atggccctccctgtcaccgccctgctgcttccgctggctcttctgctccacgccgctcggccccaagtccaactcgtccaaagcggtgcagaagtcaagaagcccggttcctccgtgaaagtgtcctgcaaagcctcgggctacaccttcactaattactggatgcattgggtccgccaggcgcccggacagggattggaatggatggggttcatcacgccgaccaccggatacccggagtacaaccagaagttcaaggacagagtgaccattaccgccgataagtccacctccaccgcttacatggagctctcctcactgcggtccgaagatacagccgtgtactattgtgctcgccggaaagtcggaaagggagtgtactacgccctggactattggggccagggcaccaccgtgaccgtgtcctcgggaggagggggttcgggcggaggcggctccggtggaggcggaagcggagggggcggatcagccattaggatgactcagtcccctttctccctctccgcgagcgtgggcgaccgcgtgacgatcacttgccgggcctcggggaacattcacaactacctggcctggtaccagcagaagccggccaaggcccctaagctgttcatctacaacaccaagacccttgcggacggagtgccatcgagattttccggctcgggctctgggaccgattacactctgactatctcaagcctgcaacctgaggacttcgccacttactactgccagcacttctggagcagcccctggactttcggtggcgggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 109 - protein, 5 aa, Artificial Sequence
  Description of Artificial Sequence: Synthetic peptide
NYNLH

SEQ ID NO: 110 - protein, 17 aa, Artificial Sequence
  Description of Artificial Sequence: Synthetic peptide
AIYPGNYDTSYNQKFKG

SEQ ID NO: 111 - protein, 13 aa, Artificial Sequence
  Description of Artificial Sequence: Synthetic peptide
VDFGHSRYWYFDV

SEQ ID NO: 112 - protein, 7 aa, Artificial Sequence
  Description of Artificial Sequence: Synthetic peptide
GYTFTNY

SEQ ID NO: 113 - protein, 6 aa, Artificial Sequence
  Description of Artificial Sequence: Synthetic peptide
YPGNYD

SEQ ID NO: 114 - protein, 13 aa, Artificial Sequence
  Description of Artificial Sequence: Synthetic peptide
VDFGHSRYWYFDV

SEQ ID NO: 115 - protein, 8 aa, Artificial Sequence
  Description of Artificial Sequence: Synthetic peptide
GYTFTNYN

SEQ ID NO: 116 - protein, 8 aa, Artificial Sequence
  Description of Artificial Sequence: Synthetic peptide
IYPGNYDT

SEQ ID NO: 117 - protein, 15 aa, Artificial Sequence
  Description of Artificial Sequence: Synthetic peptide
ARVDFGHSRYWYFDV

SEQ ID NO: 118 - protein, 122 aa, Artificial Sequence
  Description of Artificial Sequence: Synthetic polypeptide
QVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSS

SEQ ID NO: 119 - DNA, 366 bp, Artificial Sequence
  Description of Artificial Sequence: Synthetic polynucleotide
caagtccaactcgtccaatccggtgcagaagtcaagaaacccggtgcatccgtgaaagtgtcatgcaaagcctccgggtacaccttcactaactacaacctccactgggtccgccaggccccgggacagggactggagtggatgggggccatctacccgggaaactacgacacttcatacaaccagaagttcaagggcagagtgaccatgactgccgacaagagcacatcgaccgcctacatggaactcagctccctgcgctccgaggatactgccgtctactactgtgcccgggtggacttcggccactcccggtattggtatttcgatgtctggggacagggaaccaccgtgactgtgtccagc

SEQ ID NO: 120 - protein, 10 aa, Artificial Sequence
  Description of Artificial Sequence: Synthetic peptide
RATSSVSSMN

SEQ ID NO: 121 - protein, 7 aa, Artificial Sequence
  Description of Artificial Sequence: Synthetic peptide
ATSNLAS

SEQ ID NO: 122 - protein, 9 aa, Artificial Sequence
  Description of Artificial Sequence: Synthetic peptide
QQWTFNPPT

SEQ ID NO: 123 - protein, 6 aa, Artificial Sequence
  Description of Artificial Sequence: Synthetic peptide
TSSVSS

SEQ ID NO: 124 - protein, 3 aa, Artificial Sequence
  Description of Artificial Sequence: Synthetic peptide
ATS

SEQ ID NO: 125 - protein, 6 aa, Artificial Sequence
  Description of Artificial Sequence: Synthetic peptide
WTFNPP

SEQ ID NO: 126 - protein, 5 aa, Artificial Sequence
  Description of Artificial Sequence: Synthetic peptide
SSVSS

SEQ ID NO: 127 - protein, 3 aa, Artificial Sequence
  Description of Artificial Sequence: Synthetic peptide
ATS

SEQ ID NO: 128 - protein, 9 aa, Artificial Sequence
  Description of Artificial Sequence: Synthetic peptide
QQWTFNPPT

SEQ ID NO: 129 - protein, 106 aa, Artificial Sequence
  Description of Artificial Sequence: Synthetic polypeptide
EIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIK

SEQ ID NO: 130 - DNA, 318 bp, Artificial Sequence
  Description of Artificial Sequence: Synthetic polynucleotide
gaaatcgtgctgacccagtcccctgcgactctgagcctgagccctggggaacgcgccactttgtcatgccgggccacctcctccgtgtcctccatgaactggtaccagcagaagcccggacaggctccgcggccgctgatccatgccacctccaacctggccagcggcattcccgcgaggttttccggctcgggctctggtaccgactacaccctgaccatctcgagccttgagccagaagatgctgcggtgtactactgccaacagtggaccttcaatccgcctacgttcggacaggggaccaagctggagattaag

SEQ ID NO: 131 - protein, 20 aa, Artificial Sequence
  Description of Artificial Sequence: Synthetic peptide
GGGGSGGGGSGGGGSGGGGS

SEQ ID NO: 132 - protein, 248 aa, Artificial Sequence
  Description of Artificial Sequence: Synthetic polypeptide
QVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSSGGGGSGGGGSGGGGSGGGGSEIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIK

SEQ ID NO: 133 - DNA, 744 bp, Artificial Sequence
  Description of Artificial Sequence: Synthetic polynucleotide
caagtccaactcgtccaatccggtgcagaagtcaagaaacccggtgcatccgtgaaagtgtcatgcaaagcctccgggtacaccttcactaactacaacctccactgggtccgccaggccccgggacagggactggagtggatgggggccatctacccgggaaactacgacacttcatacaaccagaagttcaagggcagagtgaccatgactgccgacaagagcacatcgaccgcctacatggaactcagctccctgcgctccgaggatactgccgtctactactgtgcccgggtggacttcggccactcccggtattggtatttcgatgtctggggacagggaaccaccgtgactgtgtccagcgggggcggaggatcgggtggcggaggttcggggggaggaggatcaggcggcggcggatcggaaatcgtgctgacccagtcccctgcgactctgagcctgagccctggggaacgcgccactttgtcatgccgggccacctcctccgtgtcctccatgaactggtaccagcagaagcccggacaggctccgcggccgctgatccatgccacctccaacctggccagcggcattcccgcgaggttttccggctcgggctctggtaccgactacaccctgaccatctcgagccttgagccagaagatgctgcggtgtactactgccaacagtggaccttcaatccgcctacgttcggacaggggaccaagctggagattaag

SEQ ID NO: 134 - protein, 492 aa, Artificial Sequence
  Description of Artificial Sequence: Synthetic polypeptide
MALPVTALLLPLALLLHAARPQVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSSGGGGSGGGGSGGGGSGGGGSEIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 135 - DNA, 1476 bp, Artificial Sequence
  Description of Artificial Sequence: Synthetic polynucleotide
atggccctccctgtcaccgccctgctgcttccgctggctcttctgctccacgccgctcggccccaagtccaactcgtccaatccggtgcagaagtcaagaaacccggtgcatccgtgaaagtgtcatgcaaagcctccgggtacaccttcactaactacaacctccactgggtccgccaggccccgggacagggactggagtggatgggggccatctacccgggaaactacgacacttcatacaaccagaagttcaagggcagagtgaccatgactgccgacaagagcacatcgaccgcctacatggaactcagctccctgcgctccgaggatactgccgtctactactgtgcccgggtggacttcggccactcccggtattggtatttcgatgtctggggacagggaaccaccgtgactgtgtccagcgggggcggaggatcgggtggcggaggttcggggggaggaggatcaggcggcggcggatcggaaatcgtgctgacccagtcccctgcgactctgagcctgagccctggggaacgcgccactttgtcatgccgggccacctcctccgtgtcctccatgaactggtaccagcagaagcccggacaggctccgcggccgctgatccatgccacctccaacctggccagcggcattcccgcgaggttttccggctcgggctctggtaccgactacaccctgaccatctcgagccttgagccagaagatgctgcggtgtactactgccaacagtggaccttcaatccgcctacgttcggacaggggaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 136 - protein, 5 aa, Artificial Sequence
  Description of Artificial Sequence: Synthetic peptide
NYNLH

SEQ ID NO: 137 - protein, 17 aa, Artificial Sequence
  Description of Artificial Sequence: Synthetic peptide
AIYPGNYDTSYNQKFKG

SEQ ID NO: 138 - protein, 13 aa, Artificial Sequence
  Description of Artificial Sequence: Synthetic peptide
VDFGHSRYWYFDV

SEQ ID NO: 139 - protein, 7 aa, Artificial Sequence
  Description of Artificial Sequence: Synthetic peptide
GYTFTNY

SEQ ID NO: 140 - protein, 6 aa, Artificial Sequence
  Description of Artificial Sequence: Synthetic peptide
YPGNYD

SEQ ID NO: 141 - protein, 13 aa, Artificial Sequence
  Description of Artificial Sequence: Synthetic peptide
VDFGHSRYWYFDV

SEQ ID NO: 142 - protein, 8 aa, Artificial Sequence
  Description of Artificial Sequence: Synthetic peptide
GYTFTNYN

SEQ ID NO: 143 - protein, 8 aa, Artificial Sequence
  Description of Artificial Sequence: Synthetic peptide
IYPGNYDT

SEQ ID NO: 144 - protein, 15 aa, Artificial Sequence
  Description of Artificial Sequence: Synthetic peptide
ARVDFGHSRYWYFDV

SEQ ID NO: 145 - protein, 122 aa, Artificial Sequence; identical to SEQ ID NO: 118
  Description of Artificial Sequence: Synthetic polypeptide

SEQ ID NO: 146 - DNA, 366 bp, Artificial Sequence
  Description of Artificial Sequence: Synthetic polynucleotide
caagtccaactcgtccagtccggtgcagaagtcaagaaacctggagcatccgtgaaagtgtcttgcaaagcctccggctacaccttcaccaactacaacctccattgggtcagacaggcccccggacaaggactcgaatggatgggagcgatctacccgggaaactacgacaccagctacaaccagaagttcaagggccgcgtgactatgaccgccgataagagcacctccaccgcctacatggaactgtcctcgctgaggtccgaggacactgcggtgtactactgcgcccgcgtggacttcggacactcacggtattggtacttcgacgtctggggacagggcactaccgtgaccgtgtcgagc

SEQ ID NO: 147 - protein, 10 aa, Artificial Sequence
  Description of Artificial Sequence: Synthetic peptide
RATSSVSSMN

SEQ ID NO: 148 - protein, 7 aa, Artificial Sequence
  Description of Artificial Sequence: Synthetic peptide
ATSNLAS

SEQ ID NO: 149 - protein, 9 aa, Artificial Sequence
  Description of Artificial Sequence: Synthetic peptide
QQWTFNPPT

SEQ ID NO: 150 - protein, 6 aa, Artificial Sequence
  Description of Artificial Sequence: Synthetic peptide
TSSVSS

SEQ ID NO: 151 - protein, 3 aa, Artificial Sequence
  Description of Artificial Sequence: Synthetic peptide
ATS

SEQ ID NO: 152 - protein, 6 aa, Artificial Sequence
  Description of Artificial Sequence: Synthetic peptide
WTFNPP

SEQ ID NO: 153 - protein, 5 aa, Artificial Sequence
  Description of Artificial Sequence: Synthetic peptide
SSVSS

SEQ ID NO: 154 - protein, 3 aa, Artificial Sequence
  Description of Artificial Sequence: Synthetic peptide
ATS

SEQ ID NO: 155 - protein, 9 aa, Artificial Sequence
  Description of Artificial Sequence: Synthetic peptide
QQWTFNPPT

SEQ ID NO: 156 - protein, 106 aa, Artificial Sequence
  Description of Artificial Sequence: Synthetic polypeptide
DIQLTQSPSFLSASVGDRVTITCRATSSVSSMNWYQQKPGKAPKPLIHATSNLASGVPSRFSGSGSGTEYTLTISSLQPEDFATYYCQQWTFNPPTFGQGTKLEIK

SEQ ID NO: 157 - DNA, 318 bp, Artificial Sequence
  Description of Artificial Sequence: Synthetic polynucleotide
gatatccagctgactcagtccccgtcattcctgtccgcctccgtgggagacagagtgaccatcacctgtcgggccacttcctccgtgtcaagcatgaactggtatcagcagaagcccgggaaggccccaaagccgctgattcacgcgacgtccaacctggcttccggcgtgccgagccggttctccggctcggggagcgggactgagtacaccctgactatttcctcgcttcaacccgaggactttgctacctactactgccaacagtggaccttcaatcctccgacattcggacagggtaccaagttggaaatcaag

SEQ ID NO: 158 - protein, 20 aa, Artificial Sequence
  Description of Artificial Sequence: Synthetic peptide
GGGGSGGGGSGGGGSGGGGS

SEQ ID NO: 159 - protein, 248 aa, Artificial Sequence
  Description of Artificial Sequence: Synthetic polypeptide
QVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSSGGGGSGGGGSGGGGSGGGGSDIQLTQSPSFLSASVGDRVTITCRATSSVSSMNWYQQKPGKAPKPLIHATSNLASGVPSRFSGSGSGTEYTLTISSLQPEDFATYYCQQWTFNPPTFGQGTKLEIK

SEQ ID NO: 160 - DNA, 744 bp, Artificial Sequence
  Description of Artificial Sequence: Synthetic polynucleotide
caagtccaactcgtccagtccggtgcagaagtcaagaaacctggagcatccgtgaaagtgtcttgcaaagcctccggctacaccttcaccaactacaacctccattgggtcagacaggcccccggacaaggactcgaatggatgggagcgatctacccgggaaactacgacaccagctacaaccagaagttcaagggccgcgtgactatgaccgccgataagagcacctccaccgcctacatggaactgtcctcgctgaggtccgaggacactgcggtgtactactgcgcccgcgtggacttcggacactcacggtattggtacttcgacgtctggggacagggcactaccgtgaccgtgtcgagcggcggaggaggttcgggagggggcggatcagggggcggcggcagcggtggagggggctcggatatccagctgactcagtccccgtcattcctgtccgcctccgtgggagacagagtgaccatcacctgtcgggccacttcctccgtgtcaagcatgaactggtatcagcagaagcccgggaaggccccaaagccgctgattcacgcgacgtccaacctggcttccggcgtgccgagccggttctccggctcggggagcgggactgagtacaccctgactatttcctcgcttcaacccgaggactttgctacctactactgccaacagtggaccttcaatcctccgacattcggacagggtaccaagttggaaatcaag

SEQ ID NO: 161 - protein, 492 aa, Artificial Sequence
  Description of Artificial Sequence: Synthetic polypeptide
MALPVTALLLPLALLLHAARPQVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSSGGGGSGGGGSGGGGSGGGGSDIQLTQSPSFLSASVGDRVTITCRATSSVSSMNWYQQKPGKAPKPLIHATSNLASGVPSRFSGSGSGTEYTLTISSLQPEDFATYYCQQWTFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 162 - DNA, 1476 bp, Artificial Sequence
  Description of Artificial Sequence: Synthetic polynucleotide
atggccctccctgtcaccgccctgctgcttccgctggctcttctgctccacgccgctcggccccaagtccaactcgtccagtccggtgcagaagtcaagaaacctggagcatccgtgaaagtgtcttgcaaagcctccggctacaccttcaccaactacaacctccattgggtcagacaggcccccggacaaggactcgaatggatgggagcgatctacccgggaaactacgacaccagctacaaccagaagttcaagggccgcgtgactatgaccgccgataagagcacctccaccgcctacatggaactgtcctcgctgaggtccgaggacactgcggtgtactactgcgcccgcgtggacttcggacactcacggtattggtacttcgacgtctggggacagggcactaccgtgaccgtgtcgagcggcggaggaggttcgggagggggcggatcagggggcggcggcagcggtggagggggctcggatatccagctgactcagtccccgtcattcctgtccgcctccgtgggagacagagtgaccatcacctgtcgggccacttcctccgtgtcaagcatgaactggtatcagcagaagcccgggaaggccccaaagccgctgattcacgcgacgtccaacctggcttccggcgtgccgagccggttctccggctcggggagcgggactgagtacaccctgactatttcctcgcttcaacccgaggactttgctacctactactgccaacagtggaccttcaatcctccgacattcggacagggtaccaagttggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 163 - protein, 5 aa, Artificial Sequence
  Description of Artificial Sequence: Synthetic peptide
NYNLH

SEQ ID NO: 164 - protein, 17 aa, Artificial Sequence
  Description of Artificial Sequence: Synthetic peptide
AIYPGNYDTSYNQKFKG

SEQ ID NO: 165 - protein, 13 aa, Artificial Sequence
  Description of Artificial Sequence: Synthetic peptide
VDFGHSRYWYFDV

SEQ ID NO: 166 - protein, 7 aa, Artificial Sequence
  Description of Artificial Sequence: Synthetic peptide
GYTFTNY

SEQ ID NO: 167 - protein, 6 aa, Artificial Sequence
  Description of Artificial Sequence: Synthetic peptide
YPGNYD

SEQ ID NO: 168 - protein, 13 aa, Artificial Sequence
  Description of Artificial Sequence: Synthetic peptide
VDFGHSRYWYFDV

SEQ ID NO: 169 - protein, 8 aa, Artificial Sequence
  Description of Artificial Sequence: Synthetic peptide
GYTFTNYN

SEQ ID NO: 170 - protein, 8 aa, Artificial Sequence
  Description of Artificial Sequence: Synthetic peptide
IYPGNYDT

SEQ ID NO: 171 - protein, 15 aa, Artificial Sequence
  Description of Artificial Sequence: Synthetic peptide
ARVDFGHSRYWYFDV

SEQ ID NO: 172 - protein, 122 aa, Artificial Sequence; identical to SEQ ID NO: 10
  Description of Artificial Sequence: Synthetic polypeptide

SEQ ID NO: 173 - DNA, 366 bp, Artificial Sequence
  Description of Artificial Sequence: Synthetic polynucleotide
caagtccaactcgtccagtcgggagcagaagtcaagaagcccggatcatccgtgaaagtgtcctgcaaagcctcaggctacacctttaccaactacaacttgcactgggtcagacaggccccgggacagggcctggagtggatgggcgccatctaccccggaaactatgacacctcgtacaaccagaagttcaagggtcgcgtgactatcacggctgacaagtccactagcaccgcgtacatggaactttcctcactgcggtccgaggatactgcggtgtactactgcgcccgggtggacttcggacactcgagatattggtacttcgatgtctggggacaggggaccaccgtgactgtgtcctcc

SEQ ID NO: 174 - protein, 10 aa, Artificial Sequence
  Description of Artificial Sequence: Synthetic peptide
RATSSVSSMN

SEQ ID NO: 175 - protein, 7 aa, Artificial Sequence
  Description of Artificial Sequence: Synthetic peptide
ATSNLAS

SEQ ID NO: 176 - protein, 9 aa, Artificial Sequence
  Description of Artificial Sequence: Synthetic peptide
QQWTFNPPT

SEQ ID NO: 177 - protein, 6 aa, Artificial Sequence
  Description of Artificial Sequence: Synthetic peptide
TSSVSS

SEQ ID NO: 178 - protein, 3 aa, Artificial Sequence
  Description of Artificial Sequence: Synthetic peptide
ATS

SEQ ID NO: 179 - protein, 6 aa, Artificial Sequence
  Description of Artificial Sequence: Synthetic peptide
WTFNPP

SEQ ID NO: 180 - protein, 5 aa, Artificial Sequence
  Description of Artificial Sequence: Synthetic peptide
SSVSS

SEQ ID NO: 181 - protein, 3 aa, Artificial Sequence
  Description of Artificial Sequence: Synthetic peptide
ATS

SEQ ID NO: 182 - protein, 9 aa, Artificial Sequence
  Description of Artificial Sequence: Synthetic peptide
QQWTFNPPT

SEQ ID NO: 183 - protein, 107 aa, Artificial Sequence; identical to SEQ ID NO: 75
  Description of Artificial Sequence: Synthetic polypeptide

SEQ ID NO: 184 - DNA, 318 bp, Artificial Sequence
  Description of Artificial Sequence: Synthetic polynucleotide
gaaattgtgctgacccagtctcccgcaaccctgtccctgagccctggagagcgcgccaccctgtcctgccgggccacatcctccgtgtcgtccatgaactggtaccagcagaagcccggccaagccccgaggcctctgattcatgctacctcaaatctggccagcggaatcccggcgcgcttctccggctcgggcagcggtactgactacactctcaccatctcgtccctcgaaccggaggacgccgccgtctactactgtcagcagtggaccttcaacccacctactttcggacaagggaccaagctggagatcaag

SEQ ID NO: 185 - protein, 19 aa, Artificial Sequence
  Description of Artificial Sequence: Synthetic peptide
GGGSGGGGSGGGGSGGGGS

SEQ ID NO: 186 - protein, 249 aa, Artificial Sequence; identical to SEQ ID NO: 78
  Description of Artificial Sequence: Synthetic polypeptide

SEQ ID NO: 187 - DNA, 744 bp, Artificial Sequence
  Description of Artificial Sequence: Synthetic polynucleotide
caagtccaactcgtccagtcgggagcagaagtcaagaagcccggatcatccgtgaaagtgtcctgcaaagcctcaggctacacctttaccaactacaacttgcactgggtcagacaggccccgggacagggcctggagtggatgggcgccatctaccccggaaactatgacacctcgtacaaccagaagttcaagggtcgcgtgactatcacggctgacaagtccactagcaccgcgtacatggaactttcctcactgcggtccgaggatactgcggtgtactactgcgcccgggtggacttcggacactcgagatattggtacttcgatgtctggggacaggggaccaccgtgactgtgtcctccgggggcggtggcagcgggggaggcggaagcggcggagggggttccgggggtggaggaagcgaaattgtgctgacccagtctcccgcaaccctgtccctgagccctggagagcgcgccaccctgtcctgccgggccacatcctccgtgtcgtccatgaactggtaccagcagaagcccggccaagccccgaggcctctgattcatgctacctcaaatctggccagcggaatcccggcgcgcttctccggctcgggcagcggtactgactacactctcaccatctcgtccctcgaaccggaggacgccgccgtctactactgtcagcagtggaccttcaacccacctactttcggacaagggaccaagctggagatcaag

SEQ ID NO: 188 - protein, 492 aa, Artificial Sequence
  Description of Artificial Sequence: Synthetic polypeptide
MALPVTALLLPLALLLHAARPQVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSSGGGGSGGGGSGGGGSGGGGSEIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 189 - DNA, 1476 bp, Artificial Sequence
  Description of Artificial Sequence: Synthetic polynucleotide
atggccctccctgtcaccgccctgctgcttccgctggctcttctgctccacgccgctcggccccaagtccaactcgtccagtcgggagcagaagtcaagaagcccggatcatccgtgaaagtgtcctgcaaagcctcaggctacacctttaccaactacaacttgcactgggtcagacaggccccgggacagggcctggagtggatgggcgccatctaccccggaaactatgacacctcgtacaaccagaagttcaagggtcgcgtgactatcacggctgacaagtccactagcaccgcgtacatggaactttcctcactgcggtccgaggatactgcggtgtactactgcgcccgggtggacttcggacactcgagatattggtacttcgatgtctggggacaggggaccaccgtgactgtgtcctccgggggcggtggcagcgggggaggcggaagcggcggagggggttccgggggtggaggaagcgaaattgtgctgacccagtctcccgcaaccctgtccctgagccctggagagcgcgccaccctgtcctgccgggccacatcctccgtgtcgtccatgaactggtaccagcagaagcccggccaagccccgaggcctctgattcatgctacctcaaatctggccagcggaatcccggcgcgcttctccggctcgggcagcggtactgactacactctcaccatctcgtccctcgaaccggaggacgccgccgtctactactgtcagcagtggaccttcaacccacctactttcggacaagggaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 190 - protein, 5 aa, Artificial Sequence
  Description of Artificial Sequence: Synthetic peptide
NYNLH

SEQ ID NO: 191 - protein, 17 aa, Artificial Sequence
  Description of Artificial Sequence: Synthetic peptide
AIYPGNYDTSYNQKFKG

SEQ ID NO: 192 - protein, 13 aa, Artificial Sequence
  Description of Artificial Sequence: Synthetic peptide
VDFGHSRYWYFDV

SEQ ID NO: 193 - protein, 7 aa, Artificial Sequence
  Description of Artificial Sequence: Synthetic peptide
GYTFTNY

SEQ ID NO: 194 - protein, 6 aa, Artificial Sequence
  Description of Artificial Sequence: Synthetic peptide
YPGNYD

SEQ ID NO: 195 - protein, 13 aa, Artificial Sequence
  Description of Artificial Sequence: Synthetic peptide
VDFGHSRYWYFDV

SEQ ID NO: 196 - protein, 8 aa, Artificial Sequence
  Description of Artificial Sequence: Synthetic peptide
GYTFTNYN

SEQ ID NO: 197 - protein, 8 aa, Artificial Sequence
  Description of Artificial Sequence: Synthetic peptide
IYPGNYDT

SEQ ID NO: 198 - protein, 15 aa, Artificial Sequence
  Description of Artificial Sequence: Synthetic peptide
ARVDFGHSRYWYFDV

SEQ ID NO: 199 - protein, 122 aa, Artificial Sequence
  Description of Artificial Sequence: Synthetic polypeptide
QVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSS

SEQ ID NO: 200 - DNA, 366 bp, Artificial Sequence; identical to SEQ ID NO: 173
  Description of Artificial Sequence: Synthetic polynucleotide

SEQ ID NO: 201 - protein, 10 aa, Artificial Sequence
  Description of Artificial Sequence: Synthetic peptide
RATSSVSSMN

SEQ ID NO: 202 - protein, 7 aa, Artificial Sequence
  Description of Artificial Sequence: Synthetic peptide
ATSNLAS

SEQ ID NO: 203 - protein, 9 aa, Artificial Sequence
  Description of Artificial Sequence: Synthetic peptide
QQWTFNPPT

SEQ ID NO: 204 - protein, 6 aa, Artificial Sequence
  Description of Artificial Sequence: Synthetic peptide
TSSVSS

SEQ ID NO: 205 - protein, 3 aa, Artificial Sequence
  Description of Artificial Sequence: Synthetic peptide
ATS

SEQ ID NO: 206 - protein, 6 aa, Artificial Sequence
  Description of Artificial Sequence: Synthetic peptide
WTFNPP

SEQ ID NO: 207 - protein, 5 aa, Artificial Sequence
  Description of Artificial Sequence: Synthetic peptide
SSVSS

SEQ ID NO: 208 - protein, 3 aa, Artificial Sequence
  Description of Artificial Sequence: Synthetic peptide
ATS

SEQ ID NO: 209 - protein, 9 aa, Artificial Sequence
  Description of Artificial Sequence: Synthetic peptide
QQWTFNPPT

SEQ ID NO: 210 - protein, 106 aa, Artificial Sequence; identical to SEQ ID NO: 129
  Description of Artificial Sequence: Synthetic polypeptide

SEQ ID NO: 211 - DNA, 318 bp, Artificial Sequence; identical to SEQ ID NO: 184
  Description of Artificial Sequence: Synthetic polynucleotide

SEQ ID NO: 212 - protein, 20 aa, Artificial Sequence
  Description of Artificial Sequence: Synthetic peptide
GGGGSGGGGSGGGGSGGGGS

SEQ ID NO: 213 - protein, 248 aa, Artificial Sequence
  Description of Artificial Sequence: Synthetic polypeptide
QVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSSGGGGSGGGGSGGGGSGGGGSEIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIK

SEQ ID NO: 214 - DNA, 744 bp, Artificial Sequence
  Description of Artificial Sequence: Synthetic polynucleotide
caagtccaactcgtccaatccggcgcagaagtcaagaaaccaggatcgtccgtgaaagtgtcctgcaaggcgtccgggtacaccttcactaattacaacctccactgggtcagacaggccccaggacagggcctggaatggatgggcgccatctaccctggaaactacgatacctcgtacaaccagaagttcaagggccgcgtgactattaccgccgacaagagcacctccaccgcctatatggaactgtcgtccctgcggtccgaggacactgccgtgtactactgtgcaagggtggacttcggtcactcccggtattggtacttcgacgtctggggacaggggaccactgtgaccgtgtcgtcgggaggcggtggaagcggcggtggcggaagcggaggcggcggatcagggggcggaggaagcgacattcagcttacccagtcaccgtccttcctgagcgcctccgtgggagatcgcgtgaccatcacatgccgcgccacttcctcggtgtcctccatgaactggtaccagcagaagcccggaaaggctcctaagcctctgatccatgcgacctccaacttggcttccggggtgccgtcacggttcagcggcagcggttcaggaactgagtacaccctgactattagctctctccaacccgaggacttcgccacctactactgccagcagtggaccttcaacccgcccacgtttgggcagggtaccaagctggagatcaag

SEQ ID NO: 215 - protein, 492 aa, Artificial Sequence
  Description of Artificial Sequence: Synthetic polypeptide
MALPVTALLLPLALLLHAARPQVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSSGGGGSGGGGSGGGGSGGGGSDIQLTQSPSFLSASVGDRVTITCRATSSVSSMNWYQQKPGKAPKPLIHATSNLASGVPSRFSGSGSGTEYTLTISSLQPEDFATYYCQQWTFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 216 - DNA, 1476 bp, Artificial Sequence
  Description of Artificial Sequence: Synthetic polynucleotide
atggccctccctgtcaccgccctgctgcttccgctggctcttctgctccacgccgctcggccccaagtccaactcgtccaatccggcgcagaagtcaagaaaccaggatcgtccgtgaaagtgtcctgcaaggcgtccgggtacaccttcactaattacaacctccactgggtcagacaggccccaggacagggcctggaatggatgggcgccatctaccctggaaactacgatacctcgtacaaccagaagttcaagggccgcgtgactattaccgccgacaagagcacctccaccgcctatatggaactgtcgtccctgcggtccgaggacactgccgtgtactactgtgcaagggtggacttcggtcactcccggtattggtacttcgacgtctggggacaggggaccactgtgaccgtgtcgtcgggaggcggtggaagcggcggtggcggaagcggaggcggcggatcagggggcggaggaagcgacattcagcttacccagtcaccgtccttcctgagcgcctccgtgggagatcgcgtgaccatcacatgccgcgccacttcctcggtgtcctccatgaactggtaccagcagaagcccggaaaggctcctaagcctctgatccatgcgacctccaacttggcttccggggtgccgtcacggttcagcggcagcggttcaggaactgagtacaccctgactattagctctctccaacccgaggacttcgccacctactactgccagcagtggaccttcaacccgcccacgtttgggcagggtaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 217 - protein, 5 aa, Artificial Sequence
  Description of Artificial Sequence: Synthetic peptide
SYNMH

SEQ ID NO: 218 - protein, 17 aa, Artificial Sequence
  Description of Artificial Sequence: Synthetic peptide
AIYPGNGDTSYNPKFKG

SEQ ID NO: 219 - protein, 13 aa, Artificial Sequence
  Description of Artificial Sequence: Synthetic peptide
SYFYGSSSWYFDV

SEQ ID NO: 220 - protein, 7 aa, Artificial Sequence
  Description of Artificial Sequence: Synthetic peptide
GYTFTSY

SEQ ID NO: 221 - protein, 6 aa, Artificial Sequence
  Description of Artificial Sequence: Synthetic peptide
YPGNGD

SEQ ID NO: 222 - protein, 13 aa, Artificial Sequence
  Description of Artificial Sequence: Synthetic peptide
SYFYGSSSWYFDV

SEQ ID NO: 223 - protein, 8 aa, Artificial Sequence
  Description of Artificial Sequence: Synthetic peptide
GYTFTSYN

SEQ ID NO: 224 - protein, 8 aa, Artificial Sequence
  Description of Artificial Sequence: Synthetic peptide
IYPGNGDT

SEQ ID NO: 225 - protein, 15 aa, Artificial Sequence
  Description of Artificial Sequence: Synthetic peptide
ARSYFYGSSSWYFDV

SEQ ID NO: 226 - protein, 122 aa, Artificial Sequence
  Description of Artificial Sequence: Synthetic polypeptide
QVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSS

SEQ ID NO: 227 - DNA, 366 bp, Artificial Sequence
  Description of Artificial Sequence: Synthetic polynucleotide
caagtgcagctcgtccagtccggtgcagaagtcaagaaacccggtgcttcagtgaaagtgtcctgcaaggcctccggttacaccttcacctcctacaacatgcactgggtccgccaagccccgggccagggactcgaatggatgggagccatctaccctggcaacggggacacctcatacaaccctaagttcaagggcagagtgaccatgactgcggacaagtccactagaacagcgtacatggagctgagcagcctgcggtccgaggatactgccgtgtactactgcgcccgctcctacttctacggaagctcgtcgtggtacttcgatgtctggggacagggcaccactgtgactgtgtcctcc

SEQ ID NO: 228 - protein, 10 aa, Artificial Sequence
  Description of Artificial Sequence: Synthetic peptide
RASSSVSSMH

SEQ ID NO: 229 - protein, 7 aa, Artificial Sequence
  Description of Artificial Sequence: Synthetic peptide
ATSNLAS

SEQ ID NO: 230 - protein, 9 aa, Artificial Sequence
  Description of Artificial Sequence: Synthetic peptide
QQWIFNPPT

SEQ ID NO: 231 - protein, 6 aa, Artificial Sequence
  Description of Artificial Sequence: Synthetic peptide
SSSVSS

SEQ ID NO: 232 - protein, 3 aa, Artificial Sequence
  Description of Artificial Sequence: Synthetic peptide
ATS

SEQ ID NO: 233 - protein, 6 aa, Artificial Sequence
  Description of Artificial Sequence: Synthetic peptide
WIFNPP

SEQ ID NO: 234 - protein, 5 aa, Artificial Sequence
  Description of Artificial Sequence: Synthetic peptide
SSVSS

SEQ ID NO: 235 - protein, 3 aa, Artificial Sequence
  Description of Artificial Sequence: Synthetic peptide
ATS

SEQ ID NO: 236 - protein, 9 aa, Artificial Sequence
  Description of Artificial Sequence: Synthetic peptide
QQWIFNPPT

SEQ ID NO: 237 - protein, 106 aa, Artificial Sequence
  Description of Artificial Sequence: Synthetic polypeptide
EIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK

SEQ ID NO: 238 - DNA, 318 bp, Artificial Sequence
  Description of Artificial Sequence: Synthetic polynucleotide
gaaattgtgctgactcagagccccgccaccctgagcttgtcccccggggaaagggcaacgctgtcatgccgcgcctcgtcatccgtgtcctccatgcattggtaccagcagaagccgggacaggcccctcggccgctgatcttcgccacctccaatctcgcttccggcattccggcccggttctcgggaagcgggtcggggaccgactataccctgaccatctctagccttgaacctgaggacgccgcggtgtactattgtcaacagtggatctttaaccccccaaccttcggtggaggcaccaaagtggagattaag

SEQ ID NO: 239 - protein, 20 aa, Artificial Sequence
  Description of Artificial Sequence: Synthetic peptide
GGGGSGGGGSGGGGSGGGGS

SEQ ID NO: 240 - protein, 248 aa, Artificial Sequence
  Description of Artificial Sequence: Synthetic polypeptide
QVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK

SEQ ID NO: 241 - DNA, 744 bp, Artificial Sequence
  Description of Artificial Sequence: Synthetic polynucleotide
caagtgcagctcgtccagtccggtgcagaagtcaagaaacccggtgcttcagtgaaagtgtcctgcaaggcctccggttacaccttcacctcctacaacatgcactgggtccgccaagccccgggccagggactcgaatggatgggagccatctaccctggcaacggggacacctcatacaaccctaagttcaagggcagagtgaccatgactgcggacaagtccactagaacagcgtacatggagctgagcagcctgcggtccgaggatactgccgtgtactactgcgcccgctcctacttctacggaagctcgtcgtggtacttcgatgtctggggacagggcaccactgtgactgtgtcctccggtggcggaggctcgggcggaggcggaagcggcggcgggggatcgggaggaggagggtccgaaattgtgctgactcagagccccgccaccctgagcttgtcccccggggaaagggcaacgctgtcatgccgcgcctcgtcatccgtgtcctccatgcattggtaccagcagaagccgggacaggcccctcggccgctgatcttcgccacctccaatctcgcttccggcattccggcccggttctcgggaagcgggtcggggaccgactataccctgaccatctctagccttgaacctgaggacgccgcggtgtactattgtcaacagtggatctttaaccccccaaccttcggtggaggcaccaaagtggagattaag

SEQ ID NO: 242 - protein, 492 aa, Artificial Sequence
  Description of Artificial Sequence: Synthetic polypeptide
MALPVTALLLPLALLLHAARPQVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 243 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcagctcgtccagtccggtgcagaagtcaagaaacccggtgcttcagtgaaagtgtcctgcaaggcctccggttacaccttcacctcctacaacatgcactgggtccgccaagccccgggccagggactcgaatggatgggagccatctaccctggcaacggggacacctcatacaaccctaagttcaagggcagagtgaccatgactgcggacaagtccactagaacagcgtacatggagctgagcagcctgcggtccgaggatactgccgtgtactactgcgcccgctcctacttctacggaagctcgtcgtggtacttcgatgtctggggacagggcaccactgtgactgtgtcctccggtggcggaggctcgggcggaggcggaagcggcggcgggggatcgggaggaggagggtccgaaattgtgctgactcagagccccgccaccctgagcttgtcccccggggaaagggcaacgctgtcatgccgcgcctcgtcatccgtgtcctccatgcattggtaccagcagaagccgggacaggcccctcggccgctgatcttcgccacctccaatctcgcttccggcattccggcccggttctcgggaagcgggtcggggaccgactataccctgaccatctctagccttgaacctgaggacgccgcggtgtactattgtcaacagtggatctttaaccccccaaccttcggtggaggcaccaaagtggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 244 - protein, 5 aa, Artificial Sequence
  Description of Artificial Sequence: Synthetic peptide
SYNMH

SEQ ID NO: 245 - protein, 17 aa, Artificial Sequence
  Description of Artificial Sequence: Synthetic peptide
AIYPGNGDTSYNPKFKG

SEQ ID NO: 246 - protein, 13 aa, Artificial Sequence
  Description of Artificial Sequence: Synthetic peptide
SYFYGSSSWYFDV

SEQ ID NO: 247 - protein, 7 aa, Artificial Sequence
  Description of Artificial Sequence: Synthetic peptide
GYTFTSY

SEQ ID NO: 248 - protein, 6 aa, Artificial Sequence
  Description of Artificial Sequence: Synthetic peptide
YPGNGD

SEQ ID NO: 249 - protein, 13 aa, Artificial Sequence
  Description of Artificial Sequence: Synthetic peptide
SYFYGSSSWYFDV

SEQ ID NO: 250 - protein, 8 aa, Artificial Sequence
  Description of Artificial Sequence: Synthetic peptide
GYTFTSYN

SEQ ID NO: 251 - protein, 8 aa, Artificial Sequence
  Description of Artificial Sequence: Synthetic peptide
IYPGNGDT

SEQ ID NO: 252 - protein, 15 aa, Artificial Sequence
  Description of Artificial Sequence: Synthetic peptide
ARSYFYGSSSWYFDV

SEQ ID NO: 253 - protein, 122 aa, Artificial Sequence; identical to SEQ ID NO: 226
  Description of Artificial Sequence: Synthetic polypeptide

SEQ ID NO: 254 - DNA, 366 bp, Artificial Sequence
  Description of Artificial Sequence: Synthetic polynucleotide
caagtccaactcgtccagtcaggagcagaagtcaagaaacctggagcttccgtgaaagtgtcgtgcaaggcctccggctacaccttcacctcttacaacatgcactgggtcagacaggcccctggtcaaggactggaatggatgggagcgatctacccgggcaacggagacacttcgtacaaccccaagttcaagggacgggtcactatgaccgccgataagagcacgcgcaccgcgtacatggaactgagcagcctgcgctccgaggacactgccgtgtattactgcgcgaggagctacttctacggatcatcgtcgtggtacttcgacgtctggggccagggcaccaccgtgaccgtgtcatcc

SEQ ID NO: 255 - protein, 10 aa, Artificial Sequence
  Description of Artificial Sequence: Synthetic peptide
RASSSVSSMH

SEQ ID NO: 256 - protein, 7 aa, Artificial Sequence
  Description of Artificial Sequence: Synthetic peptide
ATSNLAS

SEQ ID NO: 257 - protein, 9 aa, Artificial Sequence
  Description of Artificial Sequence: Synthetic peptide
QQWIFNPPT

SEQ ID NO: 258 - protein, 6 aa, Artificial Sequence
  Description of Artificial Sequence: Synthetic peptide
SSSVSS

SEQ ID NO: 259 - protein, 3 aa, Artificial Sequence
  Description of Artificial Sequence: Synthetic peptide
ATS

SEQ ID NO: 260 - protein, 6 aa, Artificial Sequence
  Description of Artificial Sequence: Synthetic peptide
WIFNPP

SEQ ID NO: 261 - protein, 5 aa, Artificial Sequence
  Description of Artificial Sequence: Synthetic peptide
SSVSS

SEQ ID NO: 262 - protein, 3 aa, Artificial Sequence
  Description of Artificial Sequence: Synthetic peptide
ATS

SEQ ID NO: 263 - protein, 9 aa, Artificial Sequence
  Description of Artificial Sequence: Synthetic peptide
QQWIFNPPT

SEQ ID NO: 264 - protein, 106 aa, Artificial Sequence
  Description of Artificial Sequence: Synthetic polypeptide
DIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIK

SEQ ID NO: 265 - DNA, 318 bp, Artificial Sequence
  Description of Artificial Sequence: Synthetic polynucleotide
gatattcagctgacccagagcccgtcattcctgtccgcctccgtgggagacagagtgaccatcacttgtcgggccagctcctcggtgtcctccatgcattggtatcagcagaagcctgggaaggctcccaagcccctcatcttcgccacatcaaatcttgcctccggggtgccaagccggttctccgggagcggctccggtactgagtacactctgaccatttcctccttgcaacccgaggactttgccacctactactgccagcagtggatctttaacccgccgaccttcggaggaggaaccaaagtggagatcaag

SEQ ID NO: 266 - protein, 20 aa, Artificial Sequence
  Description of Artificial Sequence: Synthetic peptide
GGGGSGGGGSGGGGSGGGGS

SEQ ID NO: 267 - protein, 248 aa, Artificial Sequence
  Description of Artificial Sequence: Synthetic polypeptide
QVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSDIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIK

SEQ ID NO: 268 - DNA, 744 bp, Artificial Sequence
  Description of Artificial Sequence: Synthetic polynucleotide
caagtccaactcgtccagtcaggagcagaagtcaagaaacctggagcttccgtgaaagtgtcgtgcaaggcctccggctacaccttcacctcttacaacatgcactgggtcagacaggcccctggtcaaggactggaatggatgggagcgatctacccgggcaacggagacacttcgtacaaccccaagttcaagggacgggtcactatgaccgccgataagagcacgcgcaccgcgtacatggaactgagcagcctgcgctccgaggacactgccgtgtattactgcgcgaggagctacttctacggatcatcgtcgtggtacttcgacgtctggggccagggcaccaccgtgaccgtgtcatccggtggcggaggatcggggggcggaggaagcggcggggggggctccggcggtggaggctcggatattcagctgacccagagcccgtcattcctgtccgcctccgtgggagacagagtgaccatcacttgtcgggccagctcctcggtgtcctccatgcattggtatcagcagaagcctgggaaggctcccaagcccctcatcttcgccacatcaaatcttgcctccggggtgccaagccggttctccgggagcggctccggtactgagtacactctgaccatttcctccttgcaacccgaggactttgccacctactactgccagcagtggatctttaacccgccgaccttcggaggaggaaccaaagtggagatcaag

SEQ ID NO: 269 - protein, 492 aa, Artificial Sequence
  Description of Artificial Sequence: Synthetic polypeptide
MALPVTALLLPLALLLHAARPQVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSDIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 270 - DNA, 1476 bp, Artificial Sequence
  Description of Artificial Sequence: Synthetic polynucleotide
atggccctccctgtcaccgccctgctgcttccgctggctcttctgctccacgccgctcggccccaagtccaactcgtccagtcaggagcagaagtcaagaaacctggagcttccgtgaaagtgtcgtgcaaggcctccggctacaccttcacctcttacaacatgcactgggtcagacaggcccctggtcaaggactggaatggatgggagcgatctacccgggcaacggagacacttcgtacaaccccaagttcaagggacgggtcactatgaccgccgataagagcacgcgcaccgcgtacatggaactgagcagcctgcgctccgaggacactgccgtgtattactgcgcgaggagctacttctacggatcatcgtcgtggtacttcgacgtctggggccagggcaccaccgtgaccgtgtcatccggtggcggaggatcggggggcggaggaagcggcggggggggctccggcggtggaggctcggatattcagctgacccagagcccgtcattcctgtccgcctccgtgggagacagagtgaccatcacttgtcgggccagctcctcggtgtcctccatgcattggtatcagcagaagcctgggaaggctcccaagcccctcatcttcgccacatcaaatcttgcctccggggtgccaagccggttctccgggagcggctccggtactgagtacactctgaccatttcctccttgcaacccgaggactttgccacctactactgccagcagtggatctttaacccgccgaccttcggaggaggaaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 271 - protein, 5 aa, Artificial Sequence
  Description of Artificial Sequence: Synthetic peptide
SYNMH

SEQ ID NO: 272 - protein, 17 aa, Artificial Sequence
  Description of Artificial Sequence: Synthetic peptide
AIYPGNGDTSYNPKFKG

SEQ ID NO: 273 - protein, 13 aa, Artificial Sequence
  Description of Artificial Sequence: Synthetic peptide
SYFYGSSSWYFDV

SEQ ID NO: 274 - protein, 7 aa, Artificial Sequence
  Description of Artificial Sequence: Synthetic peptide
GYTFTSY

SEQ ID NO: 275 - protein, 6 aa, Artificial Sequence
  Description of Artificial Sequence: Synthetic peptide
YPGNGD

SEQ ID NO: 276 - protein, 13 aa, Artificial Sequence
  Description of Artificial Sequence: Synthetic peptide
SYFYGSSSWYFDV

SEQ ID NO: 277 - protein, 8 aa, Artificial Sequence
  Description of Artificial Sequence: Synthetic peptide
GYTFTSYN

SEQ ID NO: 278 - protein, 8 aa, Artificial Sequence
  Description of Artificial Sequence: Synthetic peptide
IYPGNGDT

SEQ ID NO: 279 - protein, 15 aa, Artificial Sequence
  Description of Artificial Sequence: Synthetic peptide
ARSYFYGSSSWYFDV

SEQ ID NO: 280 - protein, 122 aa, Artificial Sequence
  Description of Artificial Sequence: Synthetic polypeptide
QVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSS

SEQ ID NO: 281 - DNA, 366 bp, Artificial Sequence
  Description of Artificial Sequence: Synthetic polynucleotide
caagtgcaactcgtccagtccggtgcagaagtcaagaagcctggttcatcggtgaaagtgtcctgcaaagcgtcgggctacaccttcacctcgtacaacatgcactgggtccgccaggcccccggacaaggactggaatggatgggtgctatctaccccggaaacggagataccagctacaaccccaagttcaagggacgcgtgaccattactgccgacaagtccacaagaaccgcctacatggaactgtccagcctgagatccgaggacactgcggtgtactactgtgcgaggtcctacttctacgggtcctcctcttggtacttcgacgtctggggacagggcactactgtgaccgtgtccagc

SEQ ID NO: 282 - protein, 10 aa, Artificial Sequence
  Description of Artificial Sequence: Synthetic peptide
RASSSVSSMH

SEQ ID NO: 283 - protein, 7 aa, Artificial Sequence
  Description of Artificial Sequence: Synthetic peptide
ATSNLAS

SEQ ID NO: 284 - protein, 9 aa, Artificial Sequence
  Description of Artificial Sequence: Synthetic peptide
QQWIFNPPT

SEQ ID NO: 285 - protein, 6 aa, Artificial Sequence
  Description of Artificial Sequence: Synthetic peptide
SSSVSS

SEQ ID NO: 286 - protein, 3 aa, Artificial Sequence
  Description of Artificial Sequence: Synthetic peptide
ATS

SEQ ID NO: 287 - protein, 6 aa, Artificial Sequence
  Description of Artificial Sequence: Synthetic peptide
WIFNPP

SEQ ID NO: 288 - protein, 5 aa, Artificial Sequence
  Description of Artificial Sequence: Synthetic peptide
SSVSS

SEQ ID NO: 289 - protein, 3 aa, Artificial Sequence
  Description of Artificial Sequence: Synthetic peptide
ATS

SEQ ID NO: 290 - protein, 9 aa, Artificial Sequence
  Description of Artificial Sequence: Synthetic peptide
QQWIFNPPT

SEQ ID NO: 291 - protein, 106 aa, Artificial Sequence; identical to SEQ ID NO: 237
  Description of Artificial Sequence: Synthetic polypeptide

SEQ ID NO: 292 - DNA, 318 bp, Artificial Sequence
  Description of Artificial Sequence: Synthetic polynucleotide
gagatcgtgctgacgcagtcgccggccaccctgagcctttcaccgggagaacgcgccactctgtcatgccgggccagcagctccgtgtcctccatgcattggtaccagcagaagccggggcaggccccgcggcctctcatcttcgccacctccaatctggcctccggcatccctgctcggtttagcggaagcggcagcggaactgactataccttgaccatctcctcgctggaaccagaggatgcagccgtgtactattgccagcagtggatcttcaacccgccaaccttcggcggcggcaccaaggtcgagattaag

SEQ ID NO: 293 - protein, 20 aa, Artificial Sequence
  Description of Artificial Sequence: Synthetic peptide
GGGGSGGGGSGGGGSGGGGS

SEQ ID NO: 294 - protein, 248 aa, Artificial Sequence
  Description of Artificial Sequence: Synthetic polypeptide
QVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK

SEQ ID NO: 295 - DNA, 744 bp, Artificial Sequence
  Description of Artificial Sequence: Synthetic polynucleotide
caagtgcaactcgtccagtccggtgcagaagtcaagaagcctggttcatcggtgaaagtgtcctgcaaagcgtcgggctacaccttcacctcgtacaacatgcactgggtccgccaggcccccggacaaggactggaatggatgggtgctatctaccccggaaacggagataccagctacaaccccaagttcaagggacgcgtgaccattactgccgacaagtccacaagaaccgcctacatggaactgtccagcctgagatccgaggacactgcggtgtactactgtgcgaggtcctacttctacgggtcctcctcttggtacttcgacgtctggggacagggcactactgtgaccgtgtccagcgggggaggcggtagcggggggggtggatcgggcggcggcggatcaggaggaggagggtccgagatcgtgctgacgcagtcgccggccaccctgagcctttcaccgggagaacgcgccactctgtcatgccgggccagcagctccgtgtcctccatgcattggtaccagcagaagccggggcaggccccgcggcctctcatcttcgccacctccaatctggcctccggcatccctgctcggtttagcggaagcggcagcggaactgactataccttgaccatctcctcgctggaaccagaggatgcagccgtgtactattgccagcagtggatcttcaacccgccaaccttcggcggcggcaccaaggtcgagattaag

SEQ ID NO: 296 - protein, 492 aa, Artificial Sequence
  Description of Artificial Sequence: Synthetic polypeptide
MALPVTALLLPLALLLHAARPQVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 297 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaagcctggttcatcggtgaaagtgtcctgcaaagcgtcgggctacaccttcacctcgtacaacatgcactgggtccgccaggcccccggacaaggactggaatggatgggtgctatctaccccggaaacggagataccagctacaaccccaagttcaagggacgcgtgaccattactgccgacaagtccacaagaaccgcctacatggaactgtccagcctgagatccgaggacactgcggtgtactactgtgcgaggtcctacttctacgggtcctcctcttggtacttcgacgtctggggacagggcactactgtgaccgtgtccagcgggggaggcggtagcggggggggtggatcgggcggcggcggatcaggaggaggagggtccgagatcgtgctgacgcagtcgccggccaccctgagcctttcaccgggagaacgcgccactctgtcatgccgggccagcagctccgtgtcctccatgcattggtaccagcagaagccggggcaggccccgcggcctctcatcttcgccacctccaatctggcctccggcatccctgctcggtttagcggaagcggcagcggaactgactataccttgaccatctcctcgctggaaccagaggatgcagccgtgtactattgccagcagtggatcttcaacccgccaaccttcggcggcggcaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 298 - protein, 5 aa, Artificial Sequence
  Description of Artificial Sequence: Synthetic peptide
SYNMH

SEQ ID NO: 299 - protein, 17 aa, Artificial Sequence
  Description of Artificial Sequence: Synthetic peptide
AIYPGNGDTSYNPKFKG

SEQ ID NO: 300 - protein, 13 aa, Artificial Sequence
  Description of Artificial Sequence: Synthetic peptide
SYFYGSSSWYFDV

SEQ ID NO: 301 - protein, 7 aa, Artificial Sequence
  Description of Artificial Sequence: Synthetic peptide
GYTFTSY

SEQ ID NO: 302 - protein, 6 aa, Artificial Sequence
  Description of Artificial Sequence: Synthetic peptide
YPGNGD

SEQ ID NO: 303 - protein, 13 aa, Artificial Sequence
  Description of Artificial Sequence: Synthetic peptide
SYFYGSSSWYFDV

SEQ ID NO: 304 - protein, 8 aa, Artificial Sequence
  Description of Artificial Sequence: Synthetic peptide
GYTFTSYN

SEQ ID NO: 305 - protein, 8 aa, Artificial Sequence
  Description of Artificial Sequence: Synthetic peptide
IYPGNGDT

SEQ ID NO: 306 - protein, 15 aa, Artificial Sequence
  Description of Artificial Sequence: Synthetic peptide
ARSYFYGSSSWYFDV

SEQ ID NO: 307 - protein, 122 aa, Artificial Sequence; identical to SEQ ID NO: 280
  Description of Artificial Sequence: Synthetic polypeptide

SEQ ID NO: 308 - DNA, 366 bp, Artificial Sequence
  Description of Artificial Sequence: Synthetic polynucleotide
caagtgcaactcgtccagtccggtgcagaagtcaagaagccaggttcctcggtgaaagtgtcctgcaaagcctcgggttacaccttcacctcgtacaatatgcactgggtccgccaagctccgggacaaggcctggaatggatgggagcgatctaccccggaaacggcgacacgtcctacaacccgaagttcaagggaagagtgaccatcaccgccgacaagtccacccgcaccgcgtacatggagcttagcagcctgcggagcgaggacactgccgtgtattactgcgcccggtcctacttctatggatcatcctcgtggtacttcgatgtctggggccaggggaccaccgtgaccgtgtccagc

SEQ ID NO: 309 - protein, 10 aa, Artificial Sequence
  Description of Artificial Sequence: Synthetic peptide
RASSSVSSMH

SEQ ID NO: 310 - protein, 7 aa, Artificial Sequence
  Description of Artificial Sequence: Synthetic peptide
ATSNLAS

SEQ ID NO: 311 - protein, 9 aa, Artificial Sequence
  Description of Artificial Sequence: Synthetic peptide
QQWIFNPPT

SEQ ID NO: 312 - protein, 6 aa, Artificial Sequence
  Description of Artificial Sequence: Synthetic peptide
SSSVSS

SEQ ID NO: 313 - protein, 3 aa, Artificial Sequence
  Description of Artificial Sequence: Synthetic peptide
ATS

SEQ ID NO: 314 - protein, 6 aa, Artificial Sequence
  Description of Artificial Sequence: Synthetic peptide
WIFNPP

SEQ ID NO: 315 - protein, 5 aa, Artificial Sequence
  Description of Artificial Sequence: Synthetic peptide
SSVSS

SEQ ID NO: 316 - protein, 3 aa, Artificial Sequence
  Description of Artificial Sequence: Synthetic peptide
ATS

SEQ ID NO: 317 - protein, 9 aa, Artificial Sequence
  Description of Artificial Sequence: Synthetic peptide
QQWIFNPPT

SEQ ID NO: 318 - protein, 106 aa, Artificial Sequence; identical to SEQ ID NO: 264
  Description of Artificial Sequence: Synthetic polypeptide

SEQ ID NO: 319 - DNA, 318 bp, Artificial Sequence
  Description of Artificial Sequence: Synthetic polynucleotide
gatatccagctgacccagagcccttccttcctgtccgcttccgtgggagacagagtcactattacttgtcgggcctcctcatccgtgtcatccatgcactggtaccagcagaagccgggaaaggccccaaagcccttgatctttgccacttccaacctggcatccggcgtgccctcgaggttctccgggagcggttcagggaccgagtacactctgaccattagcagcctccagcctgaggactttgccacctactactgccagcagtggattttcaacccgcctacattcggagggggcactaaggtcgaaatcaag

SEQ ID NO: 320 - protein, 20 aa, Artificial Sequence
  Description of Artificial Sequence: Synthetic peptide
GGGGSGGGGSGGGGSGGGGS

SEQ ID NO: 321 - protein, 248 aa, Artificial Sequence
  Description of Artificial Sequence: Synthetic polypeptide
QVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSSGGGGSGGGGSGGGGSGGGGSDIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIK

SEQ ID NO: 322 - DNA, 744 bp, Artificial Sequence
  Description of Artificial Sequence: Synthetic polynucleotide
caagtgcaactcgtccagtccggtgcagaagtcaagaagccaggttcctcggtgaaagtgtcctgcaaagcctcgggttacaccttcacctcgtacaatatgcactgggtccgccaagctccgggacaaggcctggaatggatgggagcgatctaccccggaaacggcgacacgtcctacaacccgaagttcaagggaagagtgaccatcaccgccgacaagtccacccgcaccgcgtacatggagcttagcagcctgcggagcgaggacactgccgtgtattactgcgcccggtcctacttctatggatcatcctcgtggtacttcgatgtctggggccaggggaccaccgtgaccgtgtccagcggtggcggaggcagcggcggaggagggtctggaggaggcggctcggggggagggggctcggatatccagctgacccagagcccttccttcctgtccgcttccgtgggagacagagtcactattacttgtcgggcctcctcatccgtgtcatccatgcactggtaccagcagaagccgggaaaggccccaaagcccttgatctttgccacttccaacctggcatccggcgtgccctcgaggttctccgggagcggttcagggaccgagtacactctgaccattagcagcctccagcctgaggactttgccacctactactgccagcagtggattttcaacccgcctacattcggagggggcactaaggtcgaaatcaag

SEQ ID NO: 323 - protein, 492 aa, Artificial Sequence
  Description of Artificial Sequence: Synthetic polypeptide
MALPVTALLLPLALLLHAARPQVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSSGGGGSGGGGSGGGGSGGGGSDIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 324 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaagccaggttcctcggtgaaagtgtcctgcaaagcctcgggttacaccttcacctcgtacaatatgcactgggtccgccaagctccgggacaaggcctggaatggatgggagcgatctaccccggaaacggcgacacgtcctacaacccgaagttcaagggaagagtgaccatcaccgccgacaagtccacccgcaccgcgtacatggagcttagcagcctgcggagcgaggacactgccgtgtattactgcgcccggtcctacttctatggatcatcctcgtggtacttcgatgtctggggccaggggaccaccgtgaccgtgtccagcggtggcggaggcagcggcggaggagggtctggaggaggcggctcggggggagggggctcggatatccagctgacccagagcccttccttcctgtccgcttccgtgggagacagagtcactattacttgtcgggcctcctcatccgtgtcatccatgcactggtaccagcagaagccgggaaaggccccaaagcccttgatctttgccacttccaacctggcatccggcgtgccctcgaggttctccgggagcggttcagggaccgagtacactctgaccattagcagcctccagcctgaggactttgccacctactactgccagcagtggattttcaacccgcctacattcggagggggcactaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 325 - protein, 5 aa, Artificial Sequence
  Description of Artificial Sequence: Synthetic peptide
RYNMH

SEQ ID NO: 326 - protein, 17 aa, Artificial Sequence
  Description of Artificial Sequence: Synthetic peptide
AIYPGNGDTSYSQKFKG

SEQ ID NO: 327 - protein, 13 aa, Artificial Sequence
  Description of Artificial Sequence: Synthetic peptide
SFFYGSSDWYFDV

SEQ ID NO: 328 - protein, 7 aa, Artificial Sequence
  Description of Artificial Sequence: Synthetic peptide
GYTFTRY

SEQ ID NO: 329 - protein, 6 aa, Artificial Sequence
  Description of Artificial Sequence: Synthetic peptide
YPGNGD

SEQ ID NO: 330 - protein, 13 aa, Artificial Sequence
  Description of Artificial Sequence: Synthetic peptide
SFFYGSSDWYFDV

SEQ ID NO: 331 - protein, 8 aa, Artificial Sequence
  Description of Artificial Sequence: Synthetic peptide
GYTFTRYN

SEQ ID NO: 332 - protein, 8 aa, Artificial Sequence
  Description of Artificial Sequence: Synthetic peptide
IYPGNGDT

SEQ ID NO: 333 - protein, 15 aa, Artificial Sequence
  Description of Artificial Sequence: Synthetic peptide
ARSFFYGSSDWYFDV

SEQ ID NO: 334 - protein, 122 aa, Artificial Sequence
  Description of Artificial Sequence: Synthetic polypeptide
QVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSS

SEQ ID NO: 335 - DNA, 366 bp, Artificial Sequence
  Description of Artificial Sequence: Synthetic polynucleotide
caagtccaactcgtccagtcaggagcagaagtcaagaaaccaggagcatccgtgaaagtgtcgtgcaaagcctctggctacaccttcacccggtacaacatgcactgggtcagacaggccccgggacagcggctcgagtggatgggtgccatctaccccggcaacggggacacctcctactcccaaaagttcaagggtcgcgtgaccatcacggcggataagtcggccagcactgcgtacatggaattgtcatccctgcgctccgaggataccgccgtgtattactgcgcgcggtccttcttctacggctcctccgattggtacttcgacgtctggggacagggaactaccgtgaccgtgtcctcc

SEQ ID NO: 336 - protein, 10 aa, Artificial Sequence
  Description of Artificial Sequence: Synthetic peptide
RASSSVNNMH

SEQ ID NO: 337 - protein, 7 aa, Artificial Sequence
  Description of Artificial Sequence: Synthetic peptide
ATSNLAS

SEQ ID NO: 338 - protein, 9 aa, Artificial Sequence
  Description of Artificial Sequence: Synthetic peptide
QQWIFNPPT

SEQ ID NO: 339 - protein, 6 aa, Artificial Sequence
  Description of Artificial Sequence: Synthetic peptide
SSSVNN

SEQ ID NO: 340 - protein, 3 aa, Artificial Sequence
  Description of Artificial Sequence: Synthetic peptide
ATS

SEQ ID NO: 341 - protein, 6 aa, Artificial Sequence
  Description of Artificial Sequence: Synthetic peptide
WIFNPP

SEQ ID NO: 342 - protein, 5 aa, Artificial Sequence
  Description of Artificial Sequence: Synthetic peptide
SSVNN

SEQ ID NO: 343 - protein, 3 aa, Artificial Sequence
  Description of Artificial Sequence: Synthetic peptide
ATS

SEQ ID NO: 344 - protein, 9 aa, Artificial Sequence
  Description of Artificial Sequence: Synthetic peptide
QQWIFNPPT

SEQ ID NO: 345 - protein, 106 aa, Artificial Sequence
  Description of Artificial Sequence: Synthetic polypeptide
EIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIK

SEQ ID NO: 346 - DNA, 318 bp, Artificial Sequence
  Description of Artificial Sequence: Synthetic polynucleotide
gaaatcgtgctgactcagtcgccggacttccaaagcgtgaccccaaaggagaaggtcaccatcacctgtagagcctcatcgtccgtgaacaatatgcactggtaccagcagaagccggaccagtcccctaagcccctgatctacgccacttccaacctggcctccggcgtgccgtcgaggttcagcggctcgggcagcgggaccgactacaccctgaccatcaacagccttgaagctgaggacgccgctacctactactgccagcagtggattttcaaccctcccacatttggacagggcactaagctggagattaag

SEQ ID NO: 347 - protein, 20 aa, Artificial Sequence
  Description of Artificial Sequence: Synthetic peptide
GGGGSGGGGSGGGGSGGGGS

SEQ ID NO: 348 - protein, 248 aa, Artificial Sequence
  Description of Artificial Sequence: Synthetic polypeptide
QVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSSGGGGSGGGGSGGGGSGGGGSEIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIK

SEQ ID NO: 349 - DNA, 744 bp, Artificial Sequence
  Description of Artificial Sequence: Synthetic polynucleotide
caagtccaactcgtccagtcaggagcagaagtcaagaaaccaggagcatccgtgaaagtgtcgtgcaaagcctctggctacaccttcacccggtacaacatgcactgggtcagacaggccccgggacagcggctcgagtggatgggtgccatctaccccggcaacggggacacctcctactcccaaaagttcaagggtcgcgtgaccatcacggcggataagtcggccagcactgcgtacatggaattgtcatccctgcgctccgaggataccgccgtgtattactgcgcgcggtccttcttctacggctcctccgattggtacttcgacgtctggggacagggaactaccgtgaccgtgtcctccgggggtggcgggagcggagggggcggaagcgggggtggaggatcaggaggcggaggctccgaaatcgtgctgactcagtcgccggacttccaaagcgtgaccccaaaggagaaggtcaccatcacctgtagagcctcatcgtccgtgaacaatatgcactggtaccagcagaagccggaccagtcccctaagcccctgatctacgccacttccaacctggcctccggcgtgccgtcgaggttcagcggctcgggcagcgggaccgactacaccctgaccatcaacagccttgaagctgaggacgccgctacctactactgccagcagtggattttcaaccctcccacatttggacagggcactaagctggagattaag

SEQ ID NO: 350 - protein, 492 aa, Artificial Sequence
  Description of Artificial Sequence: Synthetic polypeptide
MALPVTALLLPLALLLHAARPQVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSSGGGGSGGGGSGGGGSGGGGSEIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 351 - DNA, 1476 bp, Artificial Sequence
  Description of Artificial Sequence: Synthetic polynucleotide
atggccctccctgtcaccgccctgctgcttccgctggctcttctgctccacgccgctcggccccaagtccaactcgtccagtcaggagcagaagtcaagaaaccaggagcatccgtgaaagtgtcgtgcaaagcctctggctacaccttcacccggtacaacatgcactgggtcagacaggccccgggacagcggctcgagtggatgggtgccatctaccccggcaacggggacacctcctactcccaaaagttcaagggtcgcgtgaccatcacggcggataagtcggccagcactgcgtacatggaattgtcatccctgcgctccgaggataccgccgtgtattactgcgcgcggtccttcttctacggctcctccgattggtacttcgacgtctggggacagggaactaccgtgaccgtgtcctccgggggtggcgggagcggagggggcggaagcgggggtggaggatcaggaggcggaggctccgaaatcgtgctgactcagtcgccggacttccaaagcgtgaccccaaaggagaaggtcaccatcacctgtagagcctcatcgtccgtgaacaatatgcactggtaccagcagaagccggaccagtcccctaagcccctgatctacgccacttccaacctggcctccggcgtgccgtcgaggttcagcggctcgggcagcgggaccgactacaccctgaccatcaacagccttgaagctgaggacgccgctacctactactgccagcagtggattttcaaccctcccacatttggacagggcactaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 352 - protein, 5 aa, Artificial Sequence
  Description of Artificial Sequence: Synthetic peptide
RYNMH

SEQ ID NO: 353 - protein, 17 aa, Artificial Sequence
  Description of Artificial Sequence: Synthetic peptide
AIYPGNGDTSYSQKFKG

SEQ ID NO: 354 - protein, 13 aa, Artificial Sequence
  Description of Artificial Sequence: Synthetic peptide
SFFYGSSDWYFDV

SEQ ID NO: 355 - protein, 7 aa, Artificial Sequence
  Description of Artificial Sequence: Synthetic peptide
GYTFTRY

SEQ ID NO: 356 - protein, 6 aa, Artificial Sequence
  Description of Artificial Sequence: Synthetic peptide
YPGNGD

SEQ ID NO: 357 - protein, 13 aa, Artificial Sequence
  Description of Artificial Sequence: Synthetic peptide
SFFYGSSDWYFDV

SEQ ID NO: 358 - protein, 8 aa, Artificial Sequence
  Description of Artificial Sequence: Synthetic peptide
GYTFTRYN

SEQ ID NO: 359 - protein, 8 aa, Artificial Sequence
  Description of Artificial Sequence: Synthetic peptide
IYPGNGDT

SEQ ID NO: 360 - protein, 15 aa, Artificial Sequence
  Description of Artificial Sequence: Synthetic peptide
ARSFFYGSSDWYFDV

SEQ ID NO: 361 - protein, 122 aa, Artificial Sequence; identical to SEQ ID NO: 334
  Description of Artificial Sequence: Synthetic polypeptide

SEQ ID NO: 362 - DNA, 366 bp, Artificial Sequence
  Description of Artificial Sequence: Synthetic polynucleotide
caagtgcaactcgtccaatccggcgcggaagtcaaaaagcctggagcctccgtcaaagtgtcctgcaaggcctccggttacactttcactcgctacaacatgcattgggtgcggcaggccccgggacagcgcctggaatggatgggcgcaatctaccccggcaacggagacacctcctattcccaaaagttcaagggaagggtcacaatcacggccgacaagagcgcctcaactgcctacatggagctgagcagcctcagatccgaagataccgcggtgtactactgcgcccggagcttcttctacggttcgtctgattggtactttgacgtctggggccagggaaccaccgtgaccgtgtcgtcc

SEQ ID NO: 363 - protein, 10 aa, Artificial Sequence
  Description of Artificial Sequence: Synthetic peptide
RASSSVNNMH

SEQ ID NO: 364 - protein, 7 aa, Artificial Sequence
  Description of Artificial Sequence: Synthetic peptide
ATSNLAS

SEQ ID NO: 365 - protein, 9 aa, Artificial Sequence
  Description of Artificial Sequence: Synthetic peptide
QQWIFNPPT

SEQ ID NO: 366 - protein, 6 aa, Artificial Sequence
  Description of Artificial Sequence: Synthetic peptide
SSSVNN

SEQ ID NO: 367 - protein, 3 aa, Artificial Sequence
  Description of Artificial Sequence: Synthetic peptide
ATS

SEQ ID NO: 368 - protein, 6 aa, Artificial Sequence
  Description of Artificial Sequence: Synthetic peptide
WIFNPP

SEQ ID NO: 369 - protein, 5 aa, Artificial Sequence
  Description of Artificial Sequence: Synthetic peptide
SSVNN

SEQ ID NO: 370 - protein, 3 aa, Artificial Sequence
  Description of Artificial Sequence: Synthetic peptide
ATS

SEQ ID NO: 371 - protein, 9 aa, Artificial Sequence
  Description of Artificial Sequence: Synthetic peptide
QQWIFNPPT

SEQ ID NO: 372 - protein, 106 aa, Artificial Sequence
  Description of Artificial Sequence: Synthetic polypeptide
DIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIK

SEQ ID NO: 373 - DNA, 318 bp, Artificial Sequence
  Description of Artificial Sequence: Synthetic polynucleotide
gacatccagcttacccagtcgccatcattcctgtccgcatcagtgggtgatcgcgtgaccattacctgtcgggcgtcctcctccgtgaacaacatgcactggtaccagcagaagccggggaaggctcccaagcctctgatctacgccactagcaatttggccagcggcgtgccttcgagattctcggggtcgggctcaggaaccgagtataccctgaccatttcctccctccaaccggaggactttgctacttactactgccagcagtggattttcaaccccccgactttcggacagggcaccaagctggaaatcaag

SEQ ID NO: 374 - protein, 20 aa, Artificial Sequence
  Description of Artificial Sequence: Synthetic peptide
GGGGSGGGGSGGGGSGGGGS

SEQ ID NO: 375 - protein, 248 aa, Artificial Sequence
  Description of Artificial Sequence: Synthetic polypeptide
QVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSSGGGGSGGGGSGGGGSGGGGSDIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIK

SEQ ID NO: 376 - DNA, 744 bp, Artificial Sequence
  Description of Artificial Sequence: Synthetic polynucleotide
caagtgcaactcgtccaatccggcgcggaagtcaaaaagcctggagcctccgtcaaagtgtcctgcaaggcctccggttacactttcactcgctacaacatgcattgggtgcggcaggccccgggacagcgcctggaatggatgggcgcaatctaccccggcaacggagacacctcctattcccaaaagttcaagggaagggtcacaatcacggccgacaagagcgcctcaactgcctacatggagctgagcagcctcagatccgaagataccgcggtgtactactgcgcccggagcttcttctacggttcgtctgattggtactttgacgtctggggccagggaaccaccgtgaccgtgtcgtccggtggcggagggagcggtggaggaggctccgggggaggaggcagcggcgggggaggcagcgacatccagcttacccagtcgccatcattcctgtccgcatcagtgggtgatcgcgtgaccattacctgtcgggcgtcctcctccgtgaacaacatgcactggtaccagcagaagccggggaaggctcccaagcctctgatctacgccactagcaatttggccagcggcgtgccttcgagattctcggggtcgggctcaggaaccgagtataccctgaccatttcctccctccaaccggaggactttgctacttactactgccagcagtggattttcaaccccccgactttcggacagggcaccaagctggaaatcaag

SEQ ID NO: 377 - protein, 492 aa, Artificial Sequence
  Description of Artificial Sequence: Synthetic polypeptide
MALPVTALLLPLALLLHAARPQVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSSGGGGSGGGGSGGGGSGGGGSDIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 378 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcaactcgtccaatccggcgcggaagtcaaaaagcctggagcctccgtcaaagtgtcctgcaaggcctccggttacactttcactcgctacaacatgcattgggtgcggcaggccccgggacagcgcctggaatggatgggcgcaatctaccccggcaacggagacacctcctattcccaaaagttcaagggaagggtcacaatcacggccgacaagagcgcctcaactgcctacatggagctgagcagcctcagatccgaagataccgcggtgtactactgcgcccggagcttcttctacggttcgtctgattggtactttgacgtctggggccagggaaccaccgtgaccgtgtcgtccggtggcggagggagcggtggaggaggctccgggggaggaggcagcggcgggggaggcagcgacatccagcttacccagtcgccatcattcctgtccgcatcagtgggtgatcgcgtgaccattacctgtcgggcgtcctcctccgtgaacaacatgcactggtaccagcagaagccggggaaggctcccaagcctctgatctacgccactagcaatttggccagcggcgtgccttcgagattctcggggtcgggctcaggaaccgagtataccctgaccatttcctccctccaaccggaggactttgctacttactactgccagcagtggattttcaaccccccgactttcggacagggcaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 379 - protein, 5 aa, Artificial Sequence
  Description of Artificial Sequence: Synthetic peptide
RYNMH

SEQ ID NO: 380 - protein, 17 aa, Artificial Sequence
  Description of Artificial Sequence: Synthetic peptide
AIYPGNGDTSYSQKFKG

SEQ ID NO: 381 - protein, 13 aa, Artificial Sequence
  Description of Artificial Sequence: Synthetic peptide
SFFYGSSDWYFDV

SEQ ID NO: 382 - protein, 7 aa, Artificial Sequence
  Description of Artificial Sequence: Synthetic peptide
GYTFTRY

SEQ ID NO: 383 - protein, 6 aa, Artificial Sequence
  Description of Artificial Sequence: Synthetic peptide
YPGNGD

SEQ ID NO: 384 - protein, 13 aa, Artificial Sequence
  Description of Artificial Sequence: Synthetic peptide
SFFYGSSDWYFDV

SEQ ID NO: 385 - protein, 8 aa, Artificial Sequence
  Description of Artificial Sequence: Synthetic peptide
GYTFTRYN

SEQ ID NO: 386 - protein, 8 aa, Artificial Sequence
  Description of Artificial Sequence: Synthetic peptide
IYPGNGDT

SEQ ID NO: 387 - protein, 15 aa, Artificial Sequence
  Description of Artificial Sequence: Synthetic peptide
ARSFFYGSSDWYFDV

SEQ ID NO: 388 - protein, 122 aa, Artificial Sequence
  Description of Artificial Sequence: Synthetic polypeptide
QVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSS

SEQ ID NO: 389 - DNA, 366 bp, Artificial Sequence
  Description of Artificial Sequence: Synthetic polynucleotide
caagtgcaactcgtccagtccggtgcagaagtcaagaagcctggttcctccgtgaaagtgtcctgcaaagcgtctggctacaccttcacccggtacaatatgcactgggtcagacaggcgcccggacagggcctggagtggatgggggccatctaccctgggaacggcgacactagctactcccaaaagttcaagggccgcgtgacgattaccgccgacaagtcaaccagcactgcctatatggagctgagctcgcttcggagcgaagataccgccgtgtactactgcgctcggagcttcttctacgggtcctcggattggtacttcgacgtctggggccaggggactactgtgaccgtgtcctcc

SEQ ID NO: 390 - protein, 10 aa, Artificial Sequence
  Description of Artificial Sequence: Synthetic peptide
RASSSVNNMH

SEQ ID NO: 391 - protein, 7 aa, Artificial Sequence
  Description of Artificial Sequence: Synthetic peptide
ATSNLAS

SEQ ID NO: 392 - protein, 9 aa, Artificial Sequence
  Description of Artificial Sequence: Synthetic peptide
QQWIFNPPT

SEQ ID NO: 393 - protein, 6 aa, Artificial Sequence
  Description of Artificial Sequence: Synthetic peptide
SSSVNN

SEQ ID NO: 394 - protein, 3 aa, Artificial Sequence
  Description of Artificial Sequence: Synthetic peptide
ATS

SEQ ID NO: 395 - protein, 6 aa, Artificial Sequence
  Description of Artificial Sequence: Synthetic peptide
WIFNPP

SEQ ID NO: 396 - protein, 5 aa, Artificial Sequence
  Description of Artificial Sequence: Synthetic peptide
SSVNN

SEQ ID NO: 397 - protein, 3 aa, Artificial Sequence
  Description of Artificial Sequence: Synthetic peptide
ATS

SEQ ID NO: 398 - protein, 9 aa, Artificial Sequence
  Description of Artificial Sequence: Synthetic peptide
QQWIFNPPT

SEQ ID NO: 399 - protein, 106 aa, Artificial Sequence; identical to SEQ ID NO: 345
  Description of Artificial Sequence: Synthetic polypeptide

SEQ ID NO: 400 - DNA, 318 bp, Artificial Sequence
  Description of Artificial Sequence: Synthetic polynucleotide
gaaatcgtgctgacccagtccccggactttcagtcagtgactcccaaggagaaggtcaccattacttgtcgcgcctcctcctcggtgaacaacatgcactggtaccagcagaagccggaccagtccccgaagcccctgatctatgctacctccaacttggcgtccggcgtgccgtcaaggttcagcggatcgggttccgggacagactacaccctgactattaactcactcgaggccgaggatgccgccacctactactgccagcagtggatcttcaaccctccaaccttcggacaaggaaccaagctggaaatcaag

SEQ ID NO: 401 - protein, 20 aa, Artificial Sequence
  Description of Artificial Sequence: Synthetic peptide
GGGGSGGGGSGGGGSGGGGS

SEQ ID NO: 402 - protein, 248 aa, Artificial Sequence
  Description of Artificial Sequence: Synthetic polypeptide
QVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSSGGGGSGGGGSGGGGSGGGGSEIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIK

SEQ ID NO: 403 - DNA, 744 bp, Artificial Sequence
  Description of Artificial Sequence: Synthetic polynucleotide
caagtgcaactcgtccagtccggtgcagaagtcaagaagcctggttcctccgtgaaagtgtcctgcaaagcgtctggctacaccttcacccggtacaatatgcactgggtcagacaggcgcccggacagggcctggagtggatgggggccatctaccctgggaacggcgacactagctactcccaaaagttcaagggccgcgtgacgattaccgccgacaagtcaaccagcactgcctatatggagctgagctcgcttcggagcgaagataccgccgtgtactactgcgctcggagcttcttctacgggtcctcggattggtacttcgacgtctggggccaggggactactgtgaccgtgtcctccgggggaggaggatcgggcggaggcggttcgggaggcggcggaagcggaggcggaggttcagaaatcgtgctgacccagtccccggactttcagtcagtgactcccaaggagaaggtcaccattacttgtcgcgcctcctcctcggtgaacaacatgcactggtaccagcagaagccggaccagtccccgaagcccctgatctatgctacctccaacttggcgtccggcgtgccgtcaaggttcagcggatcgggttccgggacagactacaccctgactattaactcactcgaggccgaggatgccgccacctactactgccagcagtggatcttcaaccctccaaccttcggacaaggaaccaagctggaaatcaag

SEQ ID NO: 404 - protein, 492 aa, Artificial Sequence
  Description of Artificial Sequence: Synthetic polypeptide
MALPVTALLLPLALLLHAARPQVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSSGGGGSGGGGSGGGGSGGGGSEIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 405 - DNA, 1476 bp, Artificial Sequence
  Description of Artificial Sequence: Synthetic polynucleotide
atggccctccctgtcaccgccctgctgcttccgctggctcttctgctccacgccgctcggccccaagtgcaactcgtccagtccggtgcagaagtcaagaagcctggttcctccgtgaaagtgtcctgcaaagcgtctggctacaccttcacccggtacaatatgcactgggtcagacaggcgcccggacagggcctggagtggatgggggccatctaccctgggaacggcgacactagctactcccaaaagttcaagggccgcgtgacgattaccgccgacaagtcaaccagcactgcctatatggagctgagctcgcttcggagcgaagataccgccgtgtactactgcgctcggagcttcttctacgggtcctcggattggtacttcgacgtctggggccaggggactactgtgaccgtgtcctccgggggaggaggatcgggcggaggcggttcgggaggcggcggaagcggaggcggaggttcagaaatcgtgctgacccagtccccggactttcagtcagtgactcccaaggagaaggtcaccattacttgtcgcgcctcctcctcggtgaacaacatgcactggtaccagcagaagccggaccagtccccgaagcccctgatctatgctacctccaacttggcgtccggcgtgccgtcaaggttcagcggatcgggttccgggacagactacaccctgactattaactcactcgaggccgaggatgccgccacctactactgccagcagtggatcttcaaccctccaaccttcggacaaggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 406 - protein, 5 aa, Artificial Sequence
  Description of Artificial Sequence: Synthetic peptide
RYNMH

SEQ ID NO: 407 - protein, 17 aa, Artificial Sequence
  Description of Artificial Sequence: Synthetic peptide
AIYPGNGDTSYSQKFKG

SEQ ID NO: 408 - protein, 13 aa, Artificial Sequence
  Description of Artificial Sequence: Synthetic peptide
SFFYGSSDWYFDV

SEQ ID NO: 409 - protein, 7 aa, Artificial Sequence
  Description of Artificial Sequence: Synthetic peptide
GYTFTRY

SEQ ID NO: 410 - protein, 6 aa, Artificial Sequence
  Description of Artificial Sequence: Synthetic peptide
YPGNGD

SEQ ID NO: 411 - protein, 13 aa, Artificial Sequence
  Description of Artificial Sequence: Synthetic peptide
SFFYGSSDWYFDV

SEQ ID NO: 412 - protein, 8 aa, Artificial Sequence
  Description of Artificial Sequence: Synthetic peptide
GYTFTRYN

SEQ ID NO: 413 - protein, 8 aa, Artificial Sequence
  Description of Artificial Sequence: Synthetic peptide
IYPGNGDT

SEQ ID NO: 414 - protein, 15 aa, Artificial Sequence
  Description of Artificial Sequence: Synthetic peptide
ARSFFYGSSDWYFDV

SEQ ID NO: 415 - protein, 122 aa, Artificial Sequence; identical to SEQ ID NO: 388
  Description of Artificial Sequence: Synthetic polypeptide

SEQ ID NO: 416 - DNA, 366 bp, Artificial Sequence
  Description of Artificial Sequence: Synthetic polynucleotide
caagtccaactcgtccagtctggcgcagaagtcaagaagcccggaagctccgtgaaagtgtcctgcaaagcgtcgggttacactttcacccggtacaacatgcactgggtcagacaggcccctggacaaggactggagtggatgggtgccatctaccctggaaacggagatacctcctactcccaaaagttcaaggggagagtgaccattaccgccgacaagtcaacttccaccgcttacatggagctcagctccctgcggtccgaagatactgcggtgtactattgcgctcgctcatttttctacggctcatcggattggtacttcgacgtctggggacagggaactaccgtgaccgtgtcctcg

SEQ ID NO: 417 - protein, 10 aa, Artificial Sequence
  Description of Artificial Sequence: Synthetic peptide
RASSSVNNMH

SEQ ID NO: 418 - protein, 7 aa, Artificial Sequence
  Description of Artificial Sequence: Synthetic peptide
ATSNLAS

SEQ ID NO: 419 - protein, 9 aa, Artificial Sequence
  Description of Artificial Sequence: Synthetic peptide
QQWIFNPPT

SEQ ID NO: 420 - protein, 6 aa, Artificial Sequence
  Description of Artificial Sequence: Synthetic peptide
SSSVNN

SEQ ID NO: 421 - protein, 3 aa, Artificial Sequence
  Description of Artificial Sequence: Synthetic peptide
ATS

SEQ ID NO: 422 - protein, 6 aa, Artificial Sequence
  Description of Artificial Sequence: Synthetic peptide
WIFNPP

SEQ ID NO: 423 - protein, 5 aa, Artificial Sequence
  Description of Artificial Sequence: Synthetic peptide
SSVNN

SEQ ID NO: 424 - protein, 3 aa, Artificial Sequence
  Description of Artificial Sequence: Synthetic peptide
ATS

SEQ ID NO: 425 - protein, 9 aa, Artificial Sequence
  Description of Artificial Sequence: Synthetic peptide
QQWIFNPPT

SEQ ID NO: 426 - protein, 106 aa, Artificial Sequence; identical to SEQ ID NO: 372
  Description of Artificial Sequence: Synthetic polypeptide

SEQ ID NO: 427 - DNA, 318 bp, Artificial Sequence
  Description of Artificial Sequence: Synthetic polynucleotide
gacatccagctgactcagtccccgtccttcctgtccgcctccgtgggggaccgcgtgacgattacttgtcgggcctcctcatccgtgaacaacatgcattggtaccagcagaagccaggaaaggcaccgaagccgcttatctatgccacctcgaatctggccagcggagtgccttcgaggtttagcggctccggctccggcaccgagtacactttgaccattagcagcctccagccggaggacttcgccacatactactgccagcagtggatcttcaacccccccaccttcggccaaggaaccaagctggaaatcaag

SEQ ID NO: 428 - protein, 20 aa, Artificial Sequence
  Description of Artificial Sequence: Synthetic peptide
GGGGSGGGGSGGGGSGGGGS

SEQ ID NO: 429 - protein, 248 aa, Artificial Sequence
  Description of Artificial Sequence: Synthetic polypeptide
QVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSSGGGGSGGGGSGGGGSGGGGSDIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIK

SEQ ID NO: 430 - DNA, 744 bp, Artificial Sequence
  Description of Artificial Sequence: Synthetic polynucleotide
caagtccaactcgtccagtctggcgcagaagtcaagaagcccggaagctccgtgaaagtgtcctgcaaagcgtcgggttacactttcacccggtacaacatgcactgggtcagacaggcccctggacaaggactggagtggatgggtgccatctaccctggaaacggagatacctcctactcccaaaagttcaaggggagagtgaccattaccgccgacaagtcaacttccaccgcttacatggagctcagctccctgcggtccgaagatactgcggtgtactattgcgctcgctcatttttctacggctcatcggattggtacttcgacgtctggggacagggaactaccgtgaccgtgtcctcggggggaggaggatcgggcggaggcggttcgggaggcggcggaagcggaggcggaggttcagacatccagctgactcagtccccgtccttcctgtccgcctccgtgggggaccgcgtgacgattacttgtcgggcctcctcatccgtgaacaacatgcattggtaccagcagaagccaggaaaggcaccgaagccgcttatctatgccacctcgaatctggccagcggagtgccttcgaggtttagcggctccggctccggcaccgagtacactttgaccattagcagcctccagccggaggacttcgccacatactactgccagcagtggatcttcaacccccccaccttcggccaaggaaccaagctggaaatcaag

SEQ ID NO: 431 - protein, 492 aa, Artificial Sequence
  Description of Artificial Sequence: Synthetic polypeptide
MALPVTALLLPLALLLHAARPQVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSSGGGGSGGGGSGGGGSGGGGSDIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 432 - DNA, 1476 bp, Artificial Sequence
  Description of Artificial Sequence: Synthetic polynucleotide
atggccctccctgtcaccgccctgctgcttccgctggctcttctgctccacgccgctcggccccaagtccaactcgtccagtctggcgcagaagtcaagaagcccggaagctccgtgaaagtgtcctgcaaagcgtcgggttacactttcacccggtacaacatgcactgggtcagacaggcccctggacaaggactggagtggatgggtgccatctaccctggaaacggagatacctcctactcccaaaagttcaaggggagagtgaccattaccgccgacaagtcaacttccaccgcttacatggagctcagctccctgcggtccgaagatactgcggtgtactattgcgctcgctcatttttctacggctcatcggattggtacttcgacgtctggggacagggaactaccgtgaccgtgtcctcggggggaggggggagcggcggagggggctcgggcggtggaggaagcggaggcggcggttcggacatccagctgactcagtccccgtccttcctgtccgcctccgtgggggaccgcgtgacgattacttgtcgggcctcctcatccgtgaacaacatgcattggtaccagcagaagccaggaaaggcaccgaagccgcttatctatgccacctcgaatctggccagcggagtgccttcgaggtttagcggctccggctccggcaccgagtacactttgaccattagcagcctccagccggaggacttcgccacatactactgccagcagtggatcttcaacccccccaccttcggccaaggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 433 - protein, 122 aa, Artificial Sequence
  Description of Artificial Sequence: Synthetic polypeptide
QVHLQQSGAELAKPGASVKMSCKASGYTFTNYWMHWVKQRPGQGLEWIGFITPTTGYPEYNQKFKDKATLTADKSSSTAYMQLSSLTSEDSAVYYCARRKVGKGVYYALDYWGQGTSVTVSS

SEQ ID NO: 434 - DNA, 366 bp, Artificial Sequence
  Description of Artificial Sequence: Synthetic polynucleotide
caagtgcatctgcagcagtcgggggccgaactggcaaagccaggcgccagcgtgaagatgagctgcaaggcctccgggtacaccttcaccaactactggatgcactgggtcaagcagcgcccgggccagggactcgagtggatcgggttcatcacgccgactaccggctacccggagtataaccagaagttcaaggacaaggccactctgactgccgacaagtcctcgtctaccgcgtacatgcaactgtcctcactgacttcggaggattccgctgtgtactactgcgcgcggaggaaagtcggaaagggagtgtactatgccctggactactggggccagggtaccagcgtcactgtgtcctcc

SEQ ID NO: 435 - protein, 107 aa, Artificial Sequence
  Description of Artificial Sequence: Synthetic polypeptide
DILMTQSPASLSASVGETVTITCRASGNIHNYLAWYQQKQGNSPQLLVYNTKTLADGVPSRFSGSGSGTQYSLKINSLQTEDFGTYYCQHFWSSPWTFGGGTKLEIK

SEQ ID NO: 436 - DNA, 321 bp, Artificial Sequence
  Description of Artificial Sequence: Synthetic polynucleotide
gacattctgatgacccagtcccctgcatcactctccgcgtccgtgggagaaaccgtgaccatcacgtgtagagcctccggcaacatccacaactacctggcctggtaccagcagaagcagggaaactcgccccaactgcttgtgtacaacaccaagaccttggctgacggagtgccttcccggttctcgggttcgggatcaggcacacagtactccctgaaaatcaatagcctccagaccgaagattttggaacctactactgccaacacttctggagctccccctggactttcggaggcggtaccaagctcgagattaag

SEQ ID NO: 437 - protein, 122 aa, Artificial Sequence
  Description of Artificial Sequence: Synthetic polypeptide
QVQLQQPGAELVKPGASVKMSCKASGYTFTNYNLHWVKQTPGQGLEWIGAIYPGNYDTSYNQKFKGKATLTADKSSSTAYMLLSSLTSEDSAVYFCARVDFGHSRYWYFDVWGAGTTVTVSS

SEQ ID NO: 438 - DNA, 366 bp, Artificial Sequence
  Description of Artificial Sequence: Synthetic polynucleotide
caagtgcagctgcagcagcctggtgccgagctcgtgaagccgggagcgtccgtgaagatgagctgcaaagcctcgggctacaccttcaccaattacaacttgcattgggtcaagcagaccccgggccagggcctcgaatggatcggagcgatctaccccgggaactacgatactagctacaaccagaagttcaagggaaaggccaccctgaccgccgataagtcctcatccaccgcctacatgctgctgtcctcgctgacttccgaggactccgctgtgtacttctgcgcccgcgtggacttcggacacagcagatattggtattttgacgtctggggcgccgggactaccgtgactgtgtcgtcc

SEQ ID NO: 439 - protein, 106 aa, Artificial Sequence
  Description of Artificial Sequence: Synthetic polypeptide
QIVLSQSPAILSASPGEKVTMTCRATSSVSSMNWYQQKPGSFPRPWIHATSNLASGVPARFSGSGSGTSYSLTISRVEAEDAATYYCQQWTFNPPTFGAGAKLELK

SEQ ID NO: 440 - DNA, 318 bp, Artificial Sequence
  Description of Artificial Sequence: Synthetic polynucleotide
caaattgtcctgagccagagcccggctatcctgtccgcctcaccgggcgaaaaggtcaccatgacttgtcgggccacttcctccgtgtcatccatgaactggtaccagcagaagcctggcagcttccctcggccatggattcacgccacgtcaaacctggcatcgggagtgcccgcaaggttctccgggtccggcagcggaacatcctactccctcaccatctcgcgcgtggaagcggaggacgctgccacctactactgccaacagtggaccttcaacccccccacctttggagcgggagccaagctggaacttaag

SEQ ID NO: 441 - protein, 122 aa, Artificial Sequence
  Description of Artificial Sequence: Synthetic polypeptide
QVQLQQPGAELVKPGASVKMSCKASGYTFTSYNMHWVKQTPGQGLEWIGAIYPGNGDTSYNPKFKGKATLTADKSSRTAYIHLSSLTSEDSVVYYCARSYFYGSSSWYFDVWGAGTTVTVSS

SEQ ID NO: 442 - DNA, 366 bp, Artificial Sequence
  Description of Artificial Sequence: Synthetic polynucleotide
caagtgcagctgcagcagccgggagcagagctcgtgaagcctggagcctcagtgaagatgagctgcaaggcctccggttacaccttcacctcctacaacatgcactgggtcaagcagacccccggacaaggcctggaatggatcggcgccatctacccgggaaacggggacacctcctataaccccaagttcaagggaaaagcaaccctgaccgcggacaagtccagcagaactgcctacatccatctttcctcgctgacgtccgaggattccgtggtgtactactgtgcccgctcctacttctacgggtcatcctcgtggtacttcgatgtctggggcgctggaaccaccgtgactgtgtcctcc

SEQ ID NO: 443 - protein, 106 aa, Artificial Sequence
  Description of Artificial Sequence: Synthetic polypeptide
QIILSQSPAILSASPGEKVTLTCRASSSVSSMHWYQQKPGSSPKPWIFATSNLASGVPARFTGSGSGTSYSLTISRVEAEDAATYYCQQWIFNPPTFGGGTSLEIK

SEQ ID NO: 444 - DNA, 318 bp, Artificial Sequence
  Description of Artificial Sequence: Synthetic polynucleotide
cagatcattctgagccagagcccggccattctgtctgcctcgcctggagaaaaagtcaccctcacttgccgggccagctcctccgtgtcctcaatgcactggtaccagcagaagcctggctcaagcccgaagccctggatcttcgccacctccaatctggcgtcaggagtgcccgcgaggttcactggatcggggtccggcacatcgtattcgctcaccatttcccgggtggaggccgaggacgccgctacttactactgccaacagtggatcttcaacccaccgacctttggcggagggacttccttggaaatcaag

SEQ ID NO: 445 - protein, 121 aa, Artificial Sequence
  Description of Artificial Sequence: Synthetic polypeptide
QIQLVQSGPELKKPGETVKISCKTSGYTFTSHGINWVKQAPRKGLKWMGWINTYTGEPTYGDDFKGRFAFSLETSARTAYLQINNLKNEDTATYFCARYGNYEEPYAMDYWGQGTSVTVSS

SEQ ID NO: 446 - DNA, 363 bp, Artificial Sequence
  Description of Artificial Sequence: Synthetic polynucleotide
caaattcagctggtgcagtcgggacctgagctcaagaagcccggagaaaccgtgaagatctcctgcaagacttccgggtacacttttacttcccacggcatcaactgggtcaagcaggcaccaaggaaggggcttaagtggatgggctggattaacacctacaccggcgaacccacctatggcgatgacttcaaaggacggttcgcgttctccctcgaaacctcagcaagaaccgcgtatttgcaaatcaacaacctgaagaacgaggacaccgccacctacttctgcgcccgctacggaaattacgaggaaccttacgctatggactactggggccagggcacttccgtgactgtgtcgtcc

SEQ ID NO: 447 - protein, 106 aa, Artificial Sequence; identical to SEQ ID NO: 439
  Description of Artificial Sequence: Synthetic polypeptide

SEQ ID NO: 448 - DNA, 318 bp, Artificial Sequence
  Description of Artificial Sequence: Synthetic polynucleotide
cagatcgtgctgagccagagccccgccatcctgagcgcttccccgggagaaaaggtcaccatgacttgccgggccactagcagcgtgtcctccatgaactggtaccagcagaagccgggctccttccctcgcccctggattcatgccacctcaaacctggccagcggagtgccagccagattctcgggatctggatcggggacgtcctactccctcaccatctcgcgggtggaggccgaagatgccgccacatactactgtcaacagtggaccttcaacccgccgacctttggagcgggggccaagctggagctgaaa

SEQ ID NO: 449 - protein, 122 aa, Artificial Sequence
  Description of Artificial Sequence: Synthetic polypeptide
QVQLQQPGAELVKPGASVKMSCKASGYTFTSYNIHWVKQTPGQGLEWIGAIYPGNGDTSYNQKFKGKATLTADKSSTTAFIHFSSLTSEDSVVYYCARSYFYGSDSWYFDVWGAGTTVTVSS

SEQ ID NO: 450 - DNA, 366 bp, Artificial Sequence
  Description of Artificial Sequence: Synthetic polynucleotide
caagtgcagcttcagcagcctggggccgaactcgtgaagccaggagcctccgtgaagatgtcatgcaaagcctccggctacacttttacctcctacaacattcattgggtcaagcagacacctggccagggcctggaatggattggtgcaatctacccgggcaacggagacacctcgtacaaccagaagtttaaggggaaggccaccctgaccgcggacaagtcaagcactaccgcgttcattcacttctcgtccttgacctccgaggatagcgtggtgtactactgcgcccgctcctatttctacggctccgattcgtggtacttcgacgtctggggagccggaactaccgtgaccgtgtcctcc

SEQ ID NO: 451 - protein, 106 aa, Artificial Sequence
  Description of Artificial Sequence: Synthetic polypeptide
QIILSQSPAILSASPGEKVTLTCRASSGVPSLHWYQQKPGSSPKPWIFATSNLASGVPARFSGSGSGTSYSLTISRVEAEDAATYYCQQWIFNPPTFGGGTSLEIK

SEQ ID NO: 452 - DNA, 318 bp, Artificial Sequence
  Description of Artificial Sequence: Synthetic polynucleotide
caaatcatcctgagccagagcccggccatcctgtcggcttcacccggggaaaaggtcacgctgacttgccgggcctcctccggcgtgccaagcctccactggtaccagcaaaagcctggctcgtcccccaaaccctggattttcgccacctccaacctggctagcggagtgccggccagattctcgggttccgggtccggcaccagctattctctcaccatctcccgggtcgaggcggaggacgcagcgacttactactgtcaacagtggatcttcaatccgcccaccttcggcggaggaacttccctggaaatcaag

SEQ ID NO: 453 - protein, 122 aa, Artificial Sequence
  Description of Artificial Sequence: Synthetic polypeptide
QVQLLQPGAELVKPGASVKMSCKASGYTFTRYNMHWVKQTPGQGLEWIGAIYPGNGDTSYSQKFKGKATLTADKSSSTAYMQLSSLTSEDSAVYYCARSFFYGSSDWYFDVWGAGTTVSVSS

SEQ ID NO: 454 - DNA, 366 bp, Artificial Sequence
  Description of Artificial Sequence: Synthetic polynucleotide
caagtgcagctgctgcagcccggagccgaactcgtgaagccgggcgcatccgtgaaaatgagctgcaaggcgtccggttacaccttcactcgctacaacatgcactgggtcaagcagacccctggacaaggcctggagtggattggtgctatctacccgggaaacggagacactagctactcgcagaaattcaagggaaaggccacgctgaccgccgataagtcctcctccactgcctacatgcaactcagctcactgacctcagaggactcggccgtgtactactgcgcgaggtccttcttctacgggtcctcggattggtacttcgacgtctggggcgccggtaccaccgtgtccgtgtcatcc

SEQ ID NO: 455 - protein, 106 aa, Artificial Sequence
  Description of Artificial Sequence: Synthetic polypeptide
QIVLSQSPAILSTSPGEKVTLTCRASSSVNNMHWYQQKPGSSPKPWIYATSNLASGVPSRFSGSGSGTSYSLTISRVEAEDAATYYCQQWIFNPPTFGAGTKLELK

SEQ ID NO: 456 - DNA, 318 bp, Artificial Sequence
  Description of Artificial Sequence: Synthetic polynucleotide
cagatcgtgctgagccagtccccggcgattctgtccacctcgcctggggaaaaggtcaccctgacatgtagagcctcctcctccgtgaacaatatgcattggtatcagcagaagccaggatcaagccccaagccctggatctatgccacttcgaaccttgcctctggagtgccctcacggttctccggctcgggatcggggaccagctacagcttgactatctcccgggtggaggctgaggacgccgcaacctactactgccagcaatggatcttcaaccctccgacttttggggccggaaccaagctggaactcaag

SEQ ID NO: 457 - protein, 117 aa, Artificial Sequence
  Description of Artificial Sequence: Synthetic polypeptide
QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTV

SEQ ID NO: 458 - DNA, 357 bp, Artificial Sequence
  Description of Artificial Sequence: Synthetic polynucleotide
caagtgcagttggtggaatcaggaggaggtgtcgtgcaaccaggaagatcattgaggctctcatgcgccgccagcggattcacctttcgggattactacatggcctgggtccgccaggccccggggaagggactggaatgggtggcatccatctcgtacgaagggaacccctactatggggactccgtgaagggacggttcaccatctcccgggacaacgccaagtccaccctgtaccttcaaatgtcctcgctgagggcggaggatactgctgtctactactgtgcccgccacgaccataacaacgtggactggttcgcctactggggccagggaaccctcgtcaccgtgtcctcg

SEQ ID NO: 459 - protein, 112 aa, Artificial Sequence
  Description of Artificial Sequence: Synthetic polypeptide
DIVMTQTPLSLSVTPGQPVSMSCKSSQSLLYSENKKNYLAWYLQKPGQSPQLLIFWASTRESGVPDRFSGSGSGTDFTLKISRVEAEDVGVYYCQQYYNFPTFGQGTKLEIK

SEQ ID NO: 460 - DNA, 336 bp, Artificial Sequence
  Description of Artificial Sequence: Synthetic polynucleotide
gacattgtgatgacgcagactcccctgtcgctctccgtgacccctggccagcccgtgtcgatgtcgtgcaagagctcccagtccctgctgtattccgagaacaagaagaattaccttgcgtggtacctccagaagccggggcagagcccgcagctgctgattttctgggcgtccactagagagtctggagtgcctgaccggtttagcggaagcggctccggtactgatttcaccctgaaaatctcgcgcgtggaagctgaggacgtgggcgtgtactactgccagcagtactacaacttccctactttcggacaaggaaccaagctggaaatcaag

SEQ ID NO: 461 - protein, 20 aa, Artificial Sequence
  Description of Artificial Sequence: Synthetic peptide
GGGGSGGGGSGGGGSGGGGS

SEQ ID NO: 462 - protein, 251 aa, Artificial Sequence
  Description of Artificial Sequence: Synthetic polypeptide
QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTVSSGGGGSGGGGSGGGGSGGGGSDIVMTQTPLSLSVTPGQPVSMSCKSSQSLLYSENKKNYLAWYLQKPGQSPQLLIFWASTRESGVPDRFSGSGSGTDFTLKISRVEAEDVGVYYCQQYYNFPTFGQGTKLEIK

SEQ ID NO: 463 - protein, 119 aa, Artificial Sequence
  Description of Artificial Sequence: Synthetic polypeptide
QVQLVQSGAEVKKPGASVKVSCKASGFTFRDYYMAWVRQAPGQRLEWMGSISYEGNPYYGDSVKGRVTITRDNSASTLYMELSSLRSEDTAVYYCARHDHNNVDWFAYWGQGTLVTVSS

SEQ ID NO: 464 - DNA, 357 bp, Artificial Sequence
  Description of Artificial Sequence: Synthetic polynucleotide
caagtccaactcgtccagtccggtgcagaagtcaagaaaccaggagcttccgtgaaagtgtcgtgcaaagcttcaggcttcaccttccgcgactattacatggcctgggtccgccaagcgcccggacagcggctggagtggatggggtccatttcctacgaggggaacccctactatggagattccgtgaagggcagagtgacgatcactcgggataactccgcctccactctctacatggaactgtcctcgcttcggagcgaagataccgcggtgtactactgcgcccgccacgaccataacaacgtggactggttcgcctactggggacaggggaccctcgtgaccgtgtcctct

SEQ ID NO: 465 - protein, 112 aa, Artificial Sequence
  Description of Artificial Sequence: Synthetic polypeptide
DIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 466 - DNA, 336 bp, Artificial Sequence
  Description of Artificial Sequence: Synthetic polynucleotide
gacattcagatgacccagtccccgagctcgctgtccgcctccgtgggagacagagtgacaatcacttgcaagagcagccagtcactgttgtactccgagaacaagaagaactacctcgcctggtaccagcagaagccgggaaaggtccctaagctgctgatcttctgggccagcactagggagtcgggagtgccgtcacggttcagcggatcgggatcgggtaccgacttcaccctgactatctcctccctgcaacctgaggacgtggccacctactactgtcagcagtactacaattttcccaccttcggccagggtaccaagctggaaatcaag

SEQ ID NO: 467 - protein, 20 aa, Artificial Sequence
  Description of Artificial Sequence: Synthetic peptide
GGGGSGGGGSGGGGSGGGGS

SEQ ID NO: 468 - protein, 251 aa, Artificial Sequence
  Description of Artificial Sequence: Synthetic polypeptide
QVQLVQSGAEVKKPGASVKVSCKASGFTFRDYYMAWVRQAPGQRLEWMGSISYEGNPYYGDSVKGRVTITRDNSASTLYMELSSLRSEDTAVYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 469 - protein, 119 aa, Artificial Sequence
  Description of Artificial Sequence: Synthetic polypeptide
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSS

SEQ ID NO: 470 - DNA, 357 bp, Artificial Sequence
  Description of Artificial Sequence: Synthetic polynucleotide
gaagtccaactggtgcagtcaggagcagaagtcaaaaaaccaggagaaagcctcaagatcagctgcaagggctcgggtttcaccttccgggactactatatggcctgggtcagacagatgccgggaaagggactggaatggatggggtcaatcagctacgagggcaacccctactacggagactccgtgaagggacaggtcacaatctcccgggacaactcgatttccactctgtatctgcaatggagctccctcaaggcctccgacactgcgatgtactactgtgcgcggcatgaccacaacaatgtggattggttcgcctactggggacagggaaccctcgtgaccgtgtccagc

SEQ ID NO: 471 - protein, 112 aa, Artificial Sequence; identical to SEQ ID NO: 465
  Description of Artificial Sequence: Synthetic polypeptide

SEQ ID NO: 472 - DNA, 336 bp, Artificial Sequence
  Description of Artificial Sequence: Synthetic polynucleotide
gatatccaaatgacccagtcgccctcctcactctccgcctccgtgggagatcgcgtgaccattacttgcaagagctcgcagtccctgctgtactccgagaacaagaagaactacttggcctggtaccagcagaagcccggcaaagtgccgaagctgcttatcttttgggcctcgaccagggaaagcggagtgccgtcacgcttctccggctccgggtctggcaccgacttcactctgactatttcctccctgcaacctgaggacgtggctacctactactgccagcagtactacaacttccctaccttcggccaagggacgaagctggagatcaag

SEQ ID NO: 473 - protein, 20 aa, Artificial Sequence
  Description of Artificial Sequence: Synthetic peptide
GGGGSGGGGSGGGGSGGGGS

SEQ ID NO: 474 - protein, 251 aa, Artificial Sequence
  Description of Artificial Sequence: Synthetic polypeptide
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 475 - protein, 119 aa, Artificial Sequence; identical to SEQ ID NO: 469
  Description of Artificial Sequence: Synthetic polypeptide

SEQ ID NO: 476 - DNA, 357 bp, Artificial Sequence
  Description of Artificial Sequence: Synthetic polynucleotide
gaagtgcagttggtccaatcaggcgcagaagtgaagaaacccggagaatcattgaagatttcgtgcaaaggaagcgggttcacattccgcgattactacatggcgtgggtcagacagatgccgggaaagggactcgagtggatggggtccatcagctacgaaggaaacccttactacggggactccgtgaagggccaggtcaccatctcccgcgacaactcaatctccactctgtatctgcaatggtcgagcctcaaggcctctgatactgcgatgtactactgcgctcggcatgaccacaacaacgtggactggttcgcttactggggacagggtacccttgtgaccgtgtcctcc

SEQ ID NO: 477 - protein, 112 aa, Artificial Sequence
  Description of Artificial Sequence: Synthetic polypeptide
EIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 478 - DNA, 336 bp, Artificial Sequence
  Description of Artificial Sequence: Synthetic polynucleotide
gagatcgtgatgactcagtcccctgccaccctctcgctgtcccccggggagagggccacgctgtcctgcaagagctcccagtcactgctgtattccgaaaacaagaagaactacctcgcctggtaccaacagaagccgggacaggccccgcggcttctgatcttctgggcctccactcgggagtccggcattccggcccgcttctccggctcggggagcggaactgacttcaccctgaccatcagcagcctgcagccagaggacctcgcagtgtactactgtcaacagtactacaatttccccacctttggccagggtaccaagctggagattaag

SEQ ID NO: 479 - protein, 20 aa, Artificial Sequence
  Description of Artificial Sequence: Synthetic peptide
GGGGSGGGGSGGGGSGGGGS

SEQ ID NO: 480 - protein, 251 aa, Artificial Sequence
  Description of Artificial Sequence: Synthetic polypeptide
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSEIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 481 - protein, 5 aa, Artificial Sequence
  Description of Artificial Sequence: Synthetic peptide
DYAMH

SEQ ID NO: 482 - protein, 17 aa, Artificial Sequence
  Description of Artificial Sequence: Synthetic peptide
TISWNSGSIGYADSVKG

SEQ ID NO: 483 - protein, 13 aa, Artificial Sequence
  Description of Artificial Sequence: Synthetic peptide
DIQYGNYYYGMDV

SEQ ID NO: 484 - protein, 7 aa, Artificial Sequence
  Description of Artificial Sequence: Synthetic peptide
GFTFNDY

SEQ ID NO: 485 - protein, 6 aa, Artificial Sequence
  Description of Artificial Sequence: Synthetic peptide
SWNSGS

SEQ ID NO: 486 - protein, 13 aa, Artificial Sequence
  Description of Artificial Sequence: Synthetic peptide
DIQYGNYYYGMDV

SEQ ID NO: 487 - protein, 8 aa, Artificial Sequence
  Description of Artificial Sequence: Synthetic peptide
GFTFNDYA

SEQ ID NO: 488 - protein, 8 aa, Artificial Sequence
  Description of Artificial Sequence: Synthetic peptide
ISWNSGSI

SEQ ID NO: 489 - protein, 15 aa, Artificial Sequence
  Description of Artificial Sequence: Synthetic peptide
AKDIQYGNYYYGMDV

SEQ ID NO: 490 - protein, 122 aa, Artificial Sequence
  Description of Artificial Sequence: Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 491 - DNA, 366 bp, Artificial Sequence
  Description of Artificial Sequence: Synthetic polynucleotide
gaggtgcagctggtcgagtcggggggaggattggtgcagccgggcagaagcctgcggctctcatgtgccgcctccggcttcacctttaacgactacgcaatgcactgggtcagacaggctcctgggaagggcctggaatgggtgtccaccatttcctggaactccgggagcatcggctacgctgactccgtgaagggccgcttcacgattagccgcgataacgcgaaaaagagcctgtacctccaaatgaactccctgcgggccgaagataccgccctttactactgcgcgaaggacattcagtatggaaactactactacggaatggacgtctggggacaggggaccacagtgaccgtgtcaagc

SEQ ID NO: 492 - protein, 11 aa, Artificial Sequence
  Description of Artificial Sequence: Synthetic peptide
RASQSVSSYLA

SEQ ID NO: 493 - protein, 7 aa, Artificial Sequence
  Description of Artificial Sequence: Synthetic peptide
DASNRAT

SEQ ID NO: 494 - protein, 9 aa, Artificial Sequence
  Description of Artificial Sequence: Synthetic peptide
QQRSNWPIT

SEQ ID NO: 495 - protein, 7 aa, Artificial Sequence
  Description of Artificial Sequence: Synthetic peptide
SQSVSSY

SEQ ID NO: 496 - protein, 3 aa, Artificial Sequence
  Description of Artificial Sequence: Synthetic peptide
DAS

SEQ ID NO: 497 - protein, 6 aa, Artificial Sequence
  Description of Artificial Sequence: Synthetic peptide
RSNWPI

SEQ ID NO: 498 - protein, 6 aa, Artificial Sequence
  Description of Artificial Sequence: Synthetic peptide
QSVSSY

SEQ ID NO: 499 - protein, 3 aa, Artificial Sequence
  Description of Artificial Sequence: Synthetic peptide
DAS

SEQ ID NO: 500 - protein, 9 aa, Artificial Sequence
  Description of Artificial Sequence: Synthetic peptide
QQRSNWPIT

SEQ ID NO: 501 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 502 - DNA, 321 bp, Artificial Sequence
  Description of Artificial Sequence: Synthetic polynucleotide
gaaatcgtgctgacccagagcccagccactttgtcactgtcccccggcgaaagagccactctgtcctgccgggcatcgcagtccgtgtcgtcctacctggcctggtaccagcaaaagcccggacaagcccctcgccttctcatctacgacgcctccaatcgcgcgaccggaatcccggccaggttctccgggagcggttcaggcactgacttcaccctgaccatctcgtccctggagccggaggatttcgccgtgtattactgccagcagcggtccaactggcccatcaccttcggccaagggactcggctcgaaatcaag

SEQ ID NO: 503 - protein, 20 aa, Artificial Sequence
  Description of Artificial Sequence: Synthetic peptide
GGGGSGGGGSGGGGSGGGGS

SEQ ID NO: 504 - protein, 249 aa, Artificial Sequence
  Description of Artificial Sequence: Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 505 - DNA, 747 bp, Artificial Sequence
  Description of Artificial Sequence: Synthetic polynucleotide
gaggtgcagctggtcgagtcggggggaggattggtgcagccgggcagaagcctgcggctctcatgtgccgcctccggcttcacctttaacgactacgcaatgcactgggtcagacaggctcctgggaagggcctggaatgggtgtccaccatttcctggaactccgggagcatcggctacgctgactccgtgaagggccgcttcacgattagccgcgataacgcgaaaaagagcctgtacctccaaatgaactccctgcgggccgaagataccgccctttactactgcgcgaaggacattcagtatggaaactactactacggaatggacgtctggggacaggggaccacagtgaccgtgtcaagcggcggtggaggatctggcggaggaggttccggtggcggtggatcgggagggggaggatcggaaatcgtgctgacccagagcccagccactttgtcactgtcccccggcgaaagagccactctgtcctgccgggcatcgcagtccgtgtcgtcctacctggcctggtaccagcaaaagcccggacaagcccctcgccttctcatctacgacgcctccaatcgcgcgaccggaatcccggccaggttctccgggagcggttcaggcactgacttcaccctgaccatctcgtccctggagccggaggatttcgccgtgtattactgccagcagcggtccaactggcccatcaccttcggccaagggactcggctcgaaatcaag

SEQ ID NO: 506 - protein, 119 aa, Artificial Sequence
  Description of Artificial Sequence: Synthetic polypeptide
EVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSS

SEQ ID NO: 507 - skipped

SEQ ID NO: 508 - protein, 112 aa, Artificial Sequence
  Description of Artificial Sequence: Synthetic polypeptide
DIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIK

SEQ ID NO: 509 - skipped

SEQ ID NO: 510 - protein, 20 aa, Artificial Sequence
  Description of Artificial Sequence: Synthetic peptide
GGGGSGGGGSGGGGSGGGGS

SEQ ID NO: 511 - protein, 251 aa, Artificial Sequence
  Description of Artificial Sequence: Synthetic polypeptide
EVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSSGGGGSGGGGSGGGGSGGGGSDIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIK

SEQ ID NO: 512 - protein, 122 aa, Artificial Sequence
  Description of Artificial Sequence: Synthetic polypeptide
EVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 513 - DNA, 366 bp, Artificial Sequence
  Description of Artificial Sequence: Synthetic polynucleotide
gaggtgcaactgcagcagtcaggagcagaactggtcaagccgggcgcatccgtcaagatgagctgcaaggcctcaggatacaccttcacttcatacaacatgcactgggtcaagcagacgcctgggcaggggctggagtggatcggtgccatctaccccggaaacggcgacacctcctacaaccagaagttcaagggaaaggccaccctcaccgctgataagtccagcagcaccgcctacatgcaactgtcgtccctgacttcggaggacagcgctgactactattgcgcccgctctaattactacggttcctcctactggttcttcgacgtgtggggcgcgggtaccactgtgactgtctccagc

SEQ ID NO: 514 - protein, 106 aa, Artificial Sequence
  Description of Artificial Sequence: Synthetic polypeptide
DIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIK

SEQ ID NO: 515 - DNA, 318 bp, Artificial Sequence
  Description of Artificial Sequence: Synthetic polynucleotide
gacatcgtgctcactcagtcgcccgccattctgagcgctagccccggcgaaaaggtcaccatgacctgtagagcgtcatcctcggtgaactacatggactggtaccagaagaagccgggatcgagccctaagccatggatctacgccacatccaatctggcgtccggcgtgccggcccggttcagcgggagcggctcaggcacctcctattccctcaccatctcgagagtggaggctgaggatgcagccacgtactactgtcagcagtggtcgttcaaccccccaacctttggtggtggaaccaagctggaaatcaag

SEQ ID NO: 516 - protein, 18 aa, Artificial Sequence
  Description of Artificial Sequence: Synthetic peptide
GSTSGGGSGGGSGGGGSS

SEQ ID NO: 517 - protein, 246 aa, Artificial Sequence
  Description of Artificial Sequence: Synthetic polypeptide
DIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKGSTSGGGSGGGSGGGGSSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 518 - DNA, 738 bp, Artificial Sequence
  Description of Artificial Sequence: Synthetic polynucleotide
gacatcgtgctcactcagtcgcccgccattctgagcgctagccccggcgaaaaggtcaccatgacctgtagagcgtcatcctcggtgaactacatggactggtaccagaagaagccgggatcgagccctaagccatggatctacgccacatccaatctggcgtccggcgtgccggcccggttcagcgggagcggctcaggcacctcctattccctcaccatctcgagagtggaggctgaggatgcagccacgtactactgtcagcagtggtcgttcaaccccccaacctttggtggtggaaccaagctggaaatcaagggaagcacctccggcggaggttccggaggagggtccggaggcggaggcagctccgaggtgcaactgcagcagtcaggagcagaactggtcaagccgggcgcatccgtcaagatgagctgcaaggcctcaggatacaccttcacttcatacaacatgcactgggtcaagcagacgcctgggcaggggctggagtggatcggtgccatctaccccggaaacggcgacacctcctacaaccagaagttcaagggaaaggccaccctcaccgctgataagtccagcagcaccgcctacatgcaactgtcgtccctgacttcggaggacagcgctgactactattgcgcccgctctaattactacggttcctcctactggttcttcgacgtgtggggcgcgggtaccactgtgactgtctccagc

SEQ ID NO: 519 - protein, 7 aa, Artificial Sequence
  Description of Artificial Sequence: Synthetic peptide
NNNAAWN

SEQ ID NO: 520 - protein, 18 aa, Artificial Sequence
  Description of Artificial Sequence: Synthetic peptide
RTYHRSTWYNDYVGSVKS

SEQ ID NO: 521 - protein, 12 aa, Artificial Sequence
  Description of Artificial Sequence: Synthetic peptide
ETDYGDYGAFDI

SEQ ID NO: 522 - protein, 9 aa, Artificial Sequence
  Description of Artificial Sequence: Synthetic peptide
GDSVSNNNA

SEQ ID NO: 523 - protein, 7 aa, Artificial Sequence
  Description of Artificial Sequence: Synthetic peptide
YHRSTWY

SEQ ID NO: 524 - protein, 12 aa, Artificial Sequence
  Description of Artificial Sequence: Synthetic peptide
ETDYGDYGAFDI

SEQ ID NO: 525 - protein, 10 aa, Artificial Sequence
  Description of Artificial Sequence: Synthetic peptide
GDSVSNNNAA

SEQ ID NO: 526 - protein, 9 aa, Artificial Sequence
  Description of Artificial Sequence: Synthetic peptide
TYHRSTWYN

SEQ ID NO: 527 - protein, 14 aa, Artificial Sequence
  Description of Artificial Sequence: Synthetic peptide
ARETDYGDYGAFDI

SEQ ID NO: 528 - protein, 124 aa, Artificial Sequence
  Description of Artificial Sequence: Synthetic polypeptide
EVQLQQSGPGLVKPSQTLSLTCAISGDSVSNNNAAWNWIRQSPSRGLEWLGRTYHRSTWYNDYVGSVKSRITINPDTSKNQFSLQLNSVTPEDTAVYYCARETDYGDYGAFDIWGQGTTVTVSS

SEQ ID NO: 529 - DNA, 372 bp, Artificial Sequence
  Description of Artificial Sequence: Synthetic polynucleotide
gaagtccaattgcaacaatcaggtcccggactcgtgaaaccttcccaaaccctctccctcacttgcgcgatcagcggagactccgtgtccaacaacaatgctgcctggaactggattaggcagagcccttcaagaggactggaatggctgggacggacttaccaccgctccacctggtacaacgattacgtggggtccgtcaagtcccggatcaccattaacccggacacttccaagaatcagttcagcctgcaacttaacagcgtgactcccgaggataccgccgtgtactactgtgcccgggaaaccgactacggggattacggagccttcgacatctggggacagggaaccaccgtgaccgtgtcctcg

SEQ ID NO: 530 - protein, 14 aa, Artificial Sequence
  Description of Artificial Sequence: Synthetic peptide
TGSRNDIGAYESVS

SEQ ID NO: 531 - protein, 7 aa, Artificial Sequence
  Description of Artificial Sequence: Synthetic peptide
GVNNRPS

SEQ ID NO: 532 - protein, 11 aa, Artificial Sequence
  Description of Artificial Sequence: Synthetic peptide
SSHTTTSTLYV

SEQ ID NO: 533 - protein, 10 aa, Artificial Sequence
  Description of Artificial Sequence: Synthetic peptide
SRNDIGAYES

SEQ ID NO: 534 - protein, 3 aa, Artificial Sequence
  Description of Artificial Sequence: Synthetic peptide
GVN

SEQ ID NO: 535 - protein, 8 aa, Artificial Sequence
  Description of Artificial Sequence: Synthetic peptide
HTTTSTLY

SEQ ID NO: 536 - protein, 9 aa, Artificial Sequence
  Description of Artificial Sequence: Synthetic peptide
RNDIGAYES

SEQ ID NO: 537 - protein, 3 aa, Artificial Sequence
  Description of Artificial Sequence: Synthetic peptide
GVN

SEQ ID NO: 538 - protein, 11 aa, Artificial Sequence
  Description of Artificial Sequence: Synthetic peptide
SSHTTTSTLYV

SEQ ID NO: 539 - protein, 111 aa, Artificial Sequence
  Description of Artificial Sequence: Synthetic polypeptide
QSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVL

SEQ ID NO: 540 - DNA, 336 bp, Artificial Sequence
  Description of Artificial Sequence: Synthetic polynucleotide
cagtcggccctgactcagccggcctccgtgtccggaagcccgggccagtccatcaccatttcgtgcactgggtcgcgcaacgacatcggcgcctacgaatccgtgtcgtggtaccagcagcaccccggcaacgccccgaagctgatcatccatggcgtcaacaacagaccatccggagtgttcgaccggttcagcgtgtcccagtcgggaaacaccgcatccctgaccattagcggcctgcaggcggaggacgaggctgactattactgctcctcacacaccaccacctctacgctctatgtgtttgggactggcaccaaggtcacagtgctggga

SEQ ID NO: 541 - protein, 15 aa, Artificial Sequence
  Description of Artificial Sequence: Synthetic peptide
GGGGSGGGGSGGGGS

SEQ ID NO: 542 - protein, 250 aa, Artificial Sequence
  Description of Artificial Sequence: Synthetic polypeptide
EVQLQQSGPGLVKPSQTLSLTCAISGDSVSNNNAAWNWIRQSPSRGLEWLGRTYHRSTWYNDYVGSVKSRITINPDTSKNQFSLQLNSVTPEDTAVYYCARETDYGDYGAFDIWGQGTTVTVSSGGGGSGGGGSGGGGSQSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVL

SEQ ID NO: 543 - DNA, 753 bp, Artificial Sequence
  Description of Artificial Sequence: Synthetic polynucleotide
gaagtccaattgcaacaatcaggtcccggactcgtgaaaccttcccaaaccctctccctcacttgcgcgatcagcggagactccgtgtccaacaacaatgctgcctggaactggattaggcagagcccttcaagaggactggaatggctgggacggacttaccaccgctccacctggtacaacgattacgtggggtccgtcaagtcccggatcaccattaacccggacacttccaagaatcagttcagcctgcaacttaacagcgtgactcccgaggataccgccgtgtactactgtgcccgggaaaccgactacggggattacggagccttcgacatctggggacagggaaccaccgtgaccgtgtcctcgggcggtggtggttcgggcggcgggggatcagggggcggaggaagccagtcggccctgactcagccggcctccgtgtccggaagcccgggccagtccatcaccatttcgtgcactgggtcgcgcaacgacatcggcgcctacgaatccgtgtcgtggtaccagcagcaccccggcaacgccccgaagctgatcatccatggcgtcaacaacagaccatccggagtgttcgaccggttcagcgtgtcccagtcgggaaacaccgcatccctgaccattagcggcctgcaggcggaggacgaggctgactattactgctcctcacacaccaccacctctacgctctatgtgtttgggactggcaccaaggtcacagtgctggga

SEQ ID NO: 544 - protein, 7 aa, Artificial Sequence
  Description of Artificial Sequence: Synthetic peptide
SNSAAWN

SEQ ID NO: 545 - protein, 18 aa, Artificial Sequence
  Description of Artificial Sequence: Synthetic peptide
RTFYRSKWYNDYAVSVKG

SEQ ID NO: 546 - protein, 9 aa, Artificial Sequence
  Description of Artificial Sequence: Synthetic peptide
GDYYYGLDV

SEQ ID NO: 547 - protein, 9 aa, Artificial Sequence
  Description of Artificial Sequence: Synthetic peptide
GDSVSSNSA

SEQ ID NO: 548 - protein, 7 aa, Artificial Sequence
  Description of Artificial Sequence: Synthetic peptide
FYRSKWY

SEQ ID NO: 549 - protein, 9 aa, Artificial Sequence
  Description of Artificial Sequence: Synthetic peptide
GDYYYGLDV

SEQ ID NO: 550 - protein, 10 aa, Artificial Sequence
  Description of Artificial Sequence: Synthetic peptide
GDSVSSNSAA

SEQ ID NO: 551 - protein, 9 aa, Artificial Sequence
  Description of Artificial Sequence: Synthetic peptide
TFYRSKWYN

SEQ ID NO: 552 - protein, 11 aa, Artificial Sequence
  Description of Artificial Sequence: Synthetic peptide
AGGDYYYGLDV

SEQ ID NO: 553 - protein, 121 aa, Artificial Sequence
  Description of Artificial Sequence: Synthetic polypeptide
EVQLQQSGPGLVNPSQTLSITCAISGDSVSSNSAAWNWIRQSPSRGLEWLGRTFYRSKWYNDYAVSVKGRITISPDTSKNQFSLQLNSVTPEDTAVYYCAGGDYYYGLDVWGQGTTVTVSS

SEQ ID NO: 554 - DNA, 363 bp, Artificial Sequence
  Description of Artificial Sequence: Synthetic polynucleotide
gaagtccagttgcaacagtcaggtcccggcctcgtcaacccatcccaaaccctttccattacctgtgccattagcggggacagcgtgtcctccaactcggccgcttggaactggatcagacagagccccagccggggtctggagtggctgggacggaccttctaccgctcaaagtggtacaacgactacgcggtgtccgtgaagggaaggattaccatctccccggatacatcgaagaatcagttctccctgcaactgaactctgtgacccctgaggataccgccgtgtactactgcgcgggaggagactactactatgggctggacgtctggggccagggaaccaccgtgactgtgtcaagc

SEQ ID NO: 555 - protein, 14 aa, Artificial Sequence
  Description of Artificial Sequence: Synthetic peptide
TGSSSDVGGYNSVS

SEQ ID NO: 556 - protein, 7 aa, Artificial Sequence
  Description of Artificial Sequence: Synthetic peptide
EVINRPS

SEQ ID NO: 557 - protein, 10 aa, Artificial Sequence
  Description of Artificial Sequence: Synthetic peptide
SSYTSSSTYV

SEQ ID NO: 558 - protein, 10 aa, Artificial Sequence
  Description of Artificial Sequence: Synthetic peptide
SSSDVGGYNS

SEQ ID NO: 559 - protein, 3 aa, Artificial Sequence
  Description of Artificial Sequence: Synthetic peptide
EVI

SEQ ID NO: 560 - protein, 7 aa, Artificial Sequence
  Description of Artificial Sequence: Synthetic peptide
YTSSSTY

SEQ ID NO: 561 - protein, 9 aa, Artificial Sequence
  Description of Artificial Sequence: Synthetic peptide
SSDVGGYNS

SEQ ID NO: 562 - protein, 3 aa, Artificial Sequence
  Description of Artificial Sequence: Synthetic peptide
EVI

SEQ ID NO: 563 - protein, 10 aa, Artificial Sequence
  Description of Artificial Sequence: Synthetic peptide
SSYTSSSTYV

SEQ ID NO: 564 - protein, 110 aa, Artificial Sequence
  Description of Artificial Sequence: Synthetic polypeptide
QSALTQPASVSGSPGQSITISCTGSSSDVGGYNSVSWYQQHPGKAPKLMIYEVINRPSGVSHRFSGSKSGNTASLTISGLQAEDEADYYCSSYTSSSTYVFGTGTKVTVL

SEQ ID NO: 565 - DNA, 330 bp, Artificial Sequence
  Description of Artificial Sequence: Synthetic polynucleotide
cagagcgccctgacccagccggccagcgtgtccgggtcgccgggccagtcgatcaccatcagctgcactgggtcatcctccgacgtgggaggctacaactccgtgtcgtggtaccagcagcacccggggaaggctcctaagctgatgatctacgaagtgatcaaccggccctccggagtctcgcatcgcttttccggttcaaagtccggaaacacggcctccctgaccatctccggactccaagccgaggatgaagcagactattactgctcctcgtacactagctcatccacttacgtgttcggaactggcaccaaagtcactgtgctc

SEQ ID NO: 566 - protein, 15 aa, Artificial Sequence
  Description of Artificial Sequence: Synthetic peptide
GGGGSGGGGSGGGGS

SEQ ID NO: 567 - protein, 246 aa, Artificial Sequence
  Description of Artificial Sequence: Synthetic polypeptide
EVQLQQSGPGLVNPSQTLSITCAISGDSVSSNSAAWNWIRQSPSRGLEWLGRTFYRSKWYNDYAVSVKGRITISPDTSKNQFSLQLNSVTPEDTAVYYCAGGDYYYGLDVWGQGTTVTVSSGGGGSGGGGSGGGGSQSALTQPASVSGSPGQSITISCTGSSSDVGGYNSVSWYQQHPGKAPKLMIYEVINRPSGVSHRFSGSKSGNTASLTISGLQAEDEADYYCSSYTSSSTYVFGTGTKVTVL

SEQ ID NO: 568 - DNA, 738 bp, Artificial Sequence
  Description of Artificial Sequence: Synthetic polynucleotide
gaagtccagttgcaacagtcaggtcccggcctcgtcaacccatcccaaaccctttccattacctgtgccattagcggggacagcgtgtcctccaactcggccgcttggaactggatcagacagagccccagccggggtctggagtggctgggacggaccttctaccgctcaaagtggtacaacgactacgcggtgtccgtgaagggaaggattaccatctccccggatacatcgaagaatcagttctccctgcaactgaactctgtgacccctgaggataccgccgtgtactactgcgcgggaggagactactactatgggctggacgtctggggccagggaaccaccgtgactgtgtcaagcggagggggcggctccggtggaggaggctcgggtggcggcggaagccagagcgccctgacccagccggccagcgtgtccgggtcgccgggccagtcgatcaccatcagctgcactgggtcatcctccgacgtgggaggctacaactccgtgtcgtggtaccagcagcacccggggaaggctcctaagctgatgatctacgaagtgatcaaccggccctccggagtctcgcatcgcttttccggttcaaagtccggaaacacggcctccctgaccatctccggactccaagccgaggatgaagcagactattactgctcctcgtacactagctcatccacttacgtgttcggaactggcaccaaagtcactgtgctc

SEQ ID NO: 569 - protein, 7 aa, Artificial Sequence
  Description of Artificial Sequence: Synthetic peptide
SNSDTWN

SEQ ID NO: 570 - protein, 18 aa, Artificial Sequence
  Description of Artificial Sequence: Synthetic peptide
RTYHRSTWYDDYASSVRG

SEQ ID NO: 571 - protein, 15 aa, Artificial Sequence
  Description of Artificial Sequence: Synthetic peptide
DRLQDGNSWSDAFDV

SEQ ID NO: 572 - protein, 9 aa, Artificial Sequence
  Description of Artificial Sequence: Synthetic peptide
GDSVLSNSD

SEQ ID NO: 573 - protein, 7 aa, Artificial Sequence
  Description of Artificial Sequence: Synthetic peptide
YHRSTWY

SEQ ID NO: 574 - protein, 15 aa, Artificial Sequence
  Description of Artificial Sequence: Synthetic peptide
DRLQDGNSWSDAFDV

SEQ ID NO: 575 - protein, 10 aa, Artificial Sequence
  Description of Artificial Sequence: Synthetic peptide
GDSVLSNSDT

SEQ ID NO: 576 - protein, 9 aa, Artificial Sequence
  Description of Artificial Sequence: Synthetic peptide
TYHRSTWYD

SEQ ID NO: 577 - protein, 17 aa, Artificial Sequence
  Description of Artificial Sequence: Synthetic peptide
ARDRLQDGNSWSDAFDV

SEQ ID NO: 578 - protein, 127 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS

SEQ ID NO: 579 - DNA, 381 bp, Artificial Sequence
  Description of Artificial Sequence: Synthetic polynucleotide
gaagtccaattgcaacagtccggtcctggcctcgtcaagccctcccaaaccctctccctgacttgcgccatctccggggattccgtgctgagcaactccgacacctggaactggattcggcagagcccgtccagaggcctggagtggctgggcaggacctaccaccggagcacttggtacgacgactacgccagctccgtgcgcggacgcgtgtcaatcaatgtggacacctccaagaaccagtacagcctgcaacttaacgctgtgactcccgaggatactggagtgtactattgtgcccgcgaccggctgcaggatggaaacagctggtccgatgccttcgatgtctggggacagggtaccatggtcacagtgtccagc

SEQ ID NO: 580 - protein, 14 aa, Artificial Sequence
  Description of Artificial Sequence: Synthetic peptide
TGSSSDIGGFNYVS

SEQ ID NO: 581 - protein, 7 aa, Artificial Sequence
  Description of Artificial Sequence: Synthetic peptide
EVTNRPS

SEQ ID NO: 582 - protein, 11 aa, Artificial Sequence
  Description of Artificial Sequence: Synthetic peptide
SSYASGSPLYV

SEQ ID NO: 583 - protein, 10 aa, Artificial Sequence
  Description of Artificial Sequence: Synthetic peptide
SSSDIGGFNY

SEQ ID NO: 584 - protein, 3 aa, Artificial Sequence
  Description of Artificial Sequence: Synthetic peptide
EVT

SEQ ID NO: 585 - protein, 8 aa, Artificial Sequence
  Description of Artificial Sequence: Synthetic peptide
YASGSPLY

SEQ ID NO: 586 - protein, 9 aa, Artificial Sequence
  Description of Artificial Sequence: Synthetic peptide
SSDIGGFNY

SEQ ID NO: 587 - protein, 3 aa, Artificial Sequence
  Description of Artificial Sequence: Synthetic peptide
EVT

SEQ ID NO: 588 - protein, 11 aa, Artificial Sequence
  Description of Artificial Sequence: Synthetic peptide
SSYASGSPLYV

SEQ ID NO: 589 - protein, 111 aa, Artificial Sequence
  Description of Artificial Sequence: Synthetic polypeptide
QSALTQPASVSGSPGQSITISCTGSSSDIGGFNYVSWYQQHAGEAPKLMIYEVTNRPSGVSDRFSGSKSDNTASLTISGLQAEDEADYYCSSYASGSPLYVFGTGTKVTVL

SEQ ID NO: 590 - DNA, 333 bp, Artificial Sequence
  Description of Artificial Sequence: Synthetic polynucleotide
cagtccgcgctgacccagcccgcctctgtgtccggatcaccgggacagtcgatcacgatctcctgcactggctcatcgtccgacattggaggttttaactacgtgtcgtggtaccagcagcatgcaggagaagccccgaagctcatgatctacgaagtgaccaaccggccttcgggggtgtcagacagattctcgggctccaagtccgacaataccgcatccctgaccattagcggcctgcaggcggaggacgaagccgactactattgctcctcgtacgcttcgggctcccctctgtacgtgttcggcactgggaccaaagtcaccgtgctc

SEQ ID NO: 591 - protein, 15 aa, Artificial Sequence
  Description of Artificial Sequence: Synthetic peptide
GGGGSGGGGSGGGGS

SEQ ID NO: 592 - protein, 253 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGSSSDIGGFNYVSWYQQHAGEAPKLMIYEVTNRPSGVSDRFSGSKSDNTASLTISGLQAEDEADYYCSSYASGSPLYVFGTGTKVTVL

SEQ ID NO: 593 - DNA, 759 bp, Artificial Sequence
  Description of Artificial Sequence: Synthetic polynucleotide
gaagtccaattgcaacagtccggtcctggcctcgtcaagccctcccaaaccctctccctgacttgcgccatctccggggattccgtgctgagcaactccgacacctggaactggattcggcagagcccgtccagaggcctggagtggctgggcaggacctaccaccggagcacttggtacgacgactacgccagctccgtgcgcggacgcgtgtcaatcaatgtggacacctccaagaaccagtacagcctgcaacttaacgctgtgactcccgaggatactggagtgtactattgtgcccgcgaccggctgcaggatggaaacagctggtccgatgccttcgatgtctggggacagggtaccatggtcacagtgtccagcggggggggcggatcaggcggcggtggctccggaggagggggttcccagtccgcgctgacccagcccgcctctgtgtccggatcaccgggacagtcgatcacgatctcctgcactggctcatcgtccgacattggaggttttaactacgtgtcgtggtaccagcagcatgcaggagaagccccgaagctcatgatctacgaagtgaccaaccggccttcgggggtgtcagacagattctcgggctccaagtccgacaataccgcatccctgaccattagcggcctgcaggcggaggacgaagccgactactattgctcctcgtacgcttcgggctcccctctgtacgtgttcggcactgggaccaaagtcaccgtgctc

SEQ ID NO: 594 - protein, 7 aa, Artificial Sequence
  Description of Artificial Sequence: Synthetic peptide
SNSDTWN

SEQ ID NO: 595 - protein, 18 aa, Artificial Sequence
  Description of Artificial Sequence: Synthetic peptide
RTYHRSTWYDDYASSVRG

SEQ ID NO: 596 - protein, 15 aa, Artificial Sequence
  Description of Artificial Sequence: Synthetic peptide
DRLQDGNSWSDAFDV

SEQ ID NO: 597 - protein, 9 aa, Artificial Sequence
  Description of Artificial Sequence: Synthetic peptide
GDSVLSNSD

SEQ ID NO: 598 - protein, 7 aa, Artificial Sequence
  Description of Artificial Sequence: Synthetic peptide
YHRSTWY

SEQ ID NO: 599 - protein, 15 aa, Artificial Sequence
  Description of Artificial Sequence: Synthetic peptide
DRLQDGNSWSDAFDV

SEQ ID NO: 600 - protein, 10 aa, Artificial Sequence
  Description of Artificial Sequence: Synthetic peptide
GDSVLSNSDT

SEQ ID NO: 601 - protein, 9 aa, Artificial Sequence
  Description of Artificial Sequence: Synthetic peptide
TYHRSTWYD

SEQ ID NO: 602 - protein, 17 aa, Artificial Sequence
  Description of Artificial Sequence: Synthetic peptide
ARDRLQDGNSWSDAFDV

SEQ ID NO: 603 - protein, 127 aa, Artificial Sequence; identical to SEQ ID NO: 578
  Description of Artificial Sequence: Synthetic polypeptide

SEQ ID NO: 604 - DNA, 381 bp, Artificial Sequence; identical to SEQ ID NO: 579
  Description of Artificial Sequence: Synthetic polynucleotide

SEQ ID NO: 605 - protein, 14 aa, Artificial Sequence
  Description of Artificial Sequence: Synthetic peptide
TGTSSDIGGYNYVS

SEQ ID NO: 606 - protein, 7 aa, Artificial Sequence
  Description of Artificial Sequence: Synthetic peptide
EVSNRPS

SEQ ID NO: 607 - protein, 11 aa, Artificial Sequence
  Description of Artificial Sequence: Synthetic peptide
SSYTSSSTLYV

SEQ ID NO: 608 - protein, 10 aa, Artificial Sequence
  Description of Artificial Sequence: Synthetic peptide
TSSDIGGYNY

SEQ ID NO: 609 - protein, 3 aa, Artificial Sequence
  Description of Artificial Sequence: Synthetic peptide
EVS

SEQ ID NO: 610 - protein, 8 aa, Artificial Sequence
  Description of Artificial Sequence: Synthetic peptide
YTSSSTLY

SEQ ID NO: 611 - protein, 9 aa, Artificial Sequence
  Description of Artificial Sequence: Synthetic peptide
SSDIGGYNY

SEQ ID NO: 612 - protein, 3 aa, Artificial Sequence
  Description of Artificial Sequence: Synthetic peptide
EVS

SEQ ID NO: 613 - protein, 11 aa, Artificial Sequence
  Description of Artificial Sequence: Synthetic peptide
SSYTSSSTLYV

SEQ ID NO: 614 - protein, 111 aa, Artificial Sequence
  Description of Artificial Sequence: Synthetic polypeptide
QSALTQPASVSGSPGQSITFSCTGTSSDIGGYNYVSWYQQHPGKAPKLMIYEVSNRPSGVSNRFSGTKSGNTASLTISGLQAEDEADYYCSSYTSSSTLYVFGTGTKLTVL

SEQ ID NO: 615 - DNA, 333 bp, Artificial Sequence
  Description of Artificial Sequence: Synthetic polynucleotide
cagtccgcgctgacccagcccgcctctgtgtccggatcaccgggacagtcgatcacgttttcctgcactggcacctcgtccgacatcggaggttacaactacgtgtcgtggtaccagcagcatccaggaaaggccccgaagctcatgatctacgaagtgtcaaaccggccttcgggggtgtcaaacagattctcgggcaccaagtccggaaataccgcatccctgaccattagcggcctgcaggcggaggacgaagccgactactattgctcctcgtacacctcgagctccactctgtacgtgttcggcactgggaccaaacttaccgtgctc

SEQ ID NO: 616 - protein, 15 aa, Artificial Sequence
  Description of Artificial Sequence: Synthetic peptide
GGGGSGGGGSGSGGS

SEQ ID NO: 617 - protein, 253 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGSGGSQSALTQPASVSGSPGQSITFSCTGTSSDIGGYNYVSWYQQHPGKAPKLMIYEVSNRPSGVSNRFSGTKSGNTASLTISGLQAEDEADYYCSSYTSSSTLYVFGTGTKLTVL

SEQ ID NO: 618 - DNA, 759 bp, Artificial Sequence
  Description of Artificial Sequence: Synthetic polynucleotide
gaagtccaattgcaacagtccggtcctggcctcgtcaagccctcccaaaccctctccctgacttgcgccatctccggggattccgtgctgagcaactccgacacctggaactggattcggcagagcccgtccagaggcctggagtggctgggcaggacctaccaccggagcacttggtacgacgactacgccagctccgtgcgcggacgcgtgtcaatcaatgtggacacctccaagaaccagtacagcctgcaacttaacgctgtgactcccgaggatactggagtgtactattgtgcccgcgaccggctgcaggatggaaacagctggtccgatgccttcgatgtctggggacagggtaccatggtcacagtgtccagcggggggggcggatcaggcggcggtggctccggatcggggggttcccagtccgcgctgacccagcccgcctctgtgtccggatcaccgggacagtcgatcacgttttcctgcactggcacctcgtccgacatcggaggttacaactacgtgtcgtggtaccagcagcatccaggaaaggccccgaagctcatgatctacgaagtgtcaaaccggccttcgggggtgtcaaacagattctcgggcaccaagtccggaaataccgcatccctgaccattagcggcctgcaggcggaggacgaagccgactactattgctcctcgtacacctcgagctccactctgtacgtgttcggcactgggaccaaacttaccgtgctc

SEQ ID NO: 619 - protein, 7 aa, Artificial Sequence
  Description of Artificial Sequence: Synthetic peptide
SNSDTWN

SEQ ID NO: 620 - protein, 18 aa, Artificial Sequence
  Description of Artificial Sequence: Synthetic peptide
RTYHRSTWYDDYASSVRG

SEQ ID NO: 621 - protein, 15 aa, Artificial Sequence
  Description of Artificial Sequence: Synthetic peptide
DRLQDGNSWSDAFDV

SEQ ID NO: 622 - protein, 9 aa, Artificial Sequence
  Description of Artificial Sequence: Synthetic peptide
GDSVLSNSD

SEQ ID NO: 623 - protein, 7 aa, Artificial Sequence
  Description of Artificial Sequence: Synthetic peptide
YHRSTWY

SEQ ID NO: 624 - protein, 15 aa, Artificial Sequence
  Description of Artificial Sequence: Synthetic peptide
DRLQDGNSWSDAFDV

SEQ ID NO: 625 - protein, 10 aa, Artificial Sequence
  Description of Artificial Sequence: Synthetic peptide
GDSVLSNSDT

SEQ ID NO: 626 - protein, 9 aa, Artificial Sequence
  Description of Artificial Sequence: Synthetic peptide
TYHRSTWYD

SEQ ID NO: 627 - protein, 17 aa, Artificial Sequence
  Description of Artificial Sequence: Synthetic peptide
ARDRLQDGNSWSDAFDV

SEQ ID NO: 628 - protein, 127 aa, Artificial Sequence
  Description of Artificial Sequence: Synthetic polypeptide
QVQLQESGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS

SEQ ID NO: 629 - DNA, 381 bp, Artificial Sequence
  Description of Artificial Sequence: Synthetic polynucleotide
caagtccaattgcaagaatccggtcctggcctcgtcaagccctcccaaaccctctccctgacttgcgccatctccggggattccgtgctgagcaactccgacacctggaactggattcggcagagcccgtccagaggcctggagtggctgggcaggacctaccaccggagcacttggtacgacgactacgccagctccgtgcgcggacgcgtgtcaatcaatgtggacacctccaagaaccagtacagcctgcaacttaacgctgtgactcccgaggatactggagtgtactattgtgcccgcgaccggctgcaggatggaaacagctggtccgatgccttcgatgtctggggacagggtaccatggtcacagtgtccagc

SEQ ID NO: 630 - protein, 14 aa, Artificial Sequence
  Description of Artificial Sequence: Synthetic peptide
TGTSSDVGGYNYVS

SEQ ID NO: 631 - protein, 7 aa, Artificial Sequence
  Description of Artificial Sequence: Synthetic peptide
EVSNRPS

SEQ ID NO: 632 - protein, 11 aa, Artificial Sequence
  Description of Artificial Sequence: Synthetic peptide
SSYTSSSTLYV

SEQ ID NO: 633 - protein, 10 aa, Artificial Sequence
  Description of Artificial Sequence: Synthetic peptide
TSSDVGGYNY

SEQ ID NO: 634 - protein, 3 aa, Artificial Sequence
  Description of Artificial Sequence: Synthetic peptide
EVS

SEQ ID NO: 635 - protein, 8 aa, Artificial Sequence
  Description of Artificial Sequence: Synthetic peptide
YTSSSTLY

SEQ ID NO: 636 - protein, 9 aa, Artificial Sequence
  Description of Artificial Sequence: Synthetic peptide
SSDVGGYNY

SEQ ID NO: 637 - protein, 3 aa, Artificial Sequence
  Description of Artificial Sequence: Synthetic peptide
EVS

SEQ ID NO: 638 - protein, 11 aa, Artificial Sequence
  Description of Artificial Sequence: Synthetic peptide
SSYTSSSTLYV

SEQ ID NO: 639 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVL

SEQ ID NO: 640 - DNA, 333 bp, Artificial Sequence
  Description of Artificial Sequence: Synthetic polynucleotide
cagtccgcgctgacccagcccgcctctgtgtccggatcaccgggacagtcgatcacgatctcctgcactggcacctcgtccgacgtgggaggttacaactacgtgtcgtggtaccagcagcatccaggaaaggccccgaagctcatgatctacgaagtgtcaaaccggccttcgggggtgtcaaacagattctcgggctccaagtccggaaataccgcatccctgaccattagcggcctgcaggcggaggacgaagccgactactattgctcctcgtacacctcgagctccactctgtacgtgttcggcactgggaccaaagtcaccgtgctc

SEQ ID NO: 641 - protein, 15 aa, Artificial Sequence
  Description of Artificial Sequence: Synthetic peptide
GGGGSGGGGSGSGGS

SEQ ID NO: 642 - protein, 253 aa, Artificial Sequence
  Description of Artificial Sequence: Synthetic polypeptide
QVQLQESGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVL

SEQ ID NO: 643 - DNA, 759 bp, Artificial Sequence
  Description of Artificial Sequence: Synthetic polynucleotide
caagtccaattgcaagaatccggtcctggcctcgtcaagccctcccaaaccctctccctgacttgcgccatctccggggattccgtgctgagcaactccgacacctggaactggattcggcagagcccgtccagaggcctggagtggctgggcaggacctaccaccggagcacttggtacgacgactacgccagctccgtgcgcggacgcgtgtcaatcaatgtggacacctccaagaaccagtacagcctgcaacttaacgctgtgactcccgaggatactggagtgtactattgtgcccgcgaccggctgcaggatggaaacagctggtccgatgccttcgatgtctggggacagggtaccatggtcacagtgtccagcggggggggcggatcaggcggcggtggctccggatcggggggttcccagtccgcgctgacccagcccgcctctgtgtccggatcaccgggacagtcgatcacgatctcctgcactggcacctcgtccgacgtgggaggttacaactacgtgtcgtggtaccagcagcatccaggaaaggccccgaagctcatgatctacgaagtgtcaaaccggccttcgggggtgtcaaacagattctcgggctccaagtccggaaataccgcatccctgaccattagcggcctgcaggcggaggacgaagccgactactattgctcctcgtacacctcgagctccactctgtacgtgttcggcactgggaccaaagtcaccgtgctc

SEQ ID NO: 644 - protein, 7 aa, Artificial Sequence
  Description of Artificial Sequence: Synthetic peptide
SNSDTWN

SEQ ID NO: 645 - protein, 18 aa, Artificial Sequence
  Description of Artificial Sequence: Synthetic peptide
RTYHRSTWYDDYASSVRG

SEQ ID NO: 646 - protein, 15 aa, Artificial Sequence
  Description of Artificial Sequence: Synthetic peptide
DRLQDGNSWSDAFDV

SEQ ID NO: 647 - protein, 9 aa, Artificial Sequence
  Description of Artificial Sequence: Synthetic peptide
GDSVLSNSD

SEQ ID NO: 648 - protein, 7 aa, Artificial Sequence
  Description of Artificial Sequence: Synthetic peptide
YHRSTWY

SEQ ID NO: 649 - protein, 15 aa, Artificial Sequence
  Description of Artificial Sequence: Synthetic peptide
DRLQDGNSWSDAFDV

SEQ ID NO: 650 - protein, 10 aa, Artificial Sequence
  Description of Artificial Sequence: Synthetic peptide
GDSVLSNSDT

SEQ ID NO: 651 - protein, 9 aa, Artificial Sequence
  Description of Artificial Sequence: Synthetic peptide
TYHRSTWYD

SEQ ID NO: 652 - protein, 17 aa, Artificial Sequence
  Description of Artificial Sequence: Synthetic peptide
ARDRLQDGNSWSDAFDV

SEQ ID NO: 653 - protein, 127 aa, Artificial Sequence; identical to SEQ ID NO: 578
  Description of Artificial Sequence: Synthetic polypeptide

SEQ ID NO: 654 - DNA, 381 bp, Artificial Sequence; identical to SEQ ID NO: 579
  Description of Artificial Sequence: Synthetic polynucleotide

SEQ ID NO: 655 - protein, 14 aa, Artificial Sequence
  Description of Artificial Sequence: Synthetic peptide
TGTSSDVGGYNYVS

SEQ ID NO: 656 - protein, 7 aa, Artificial Sequence
  Description of Artificial Sequence: Synthetic peptide
DVSNRPS

SEQ ID NO: 657 - protein, 11 aa, Artificial Sequence
  Description of Artificial Sequence: Synthetic peptide
SSYTSSSTLYV

SEQ ID NO: 658 - protein, 10 aa, Artificial Sequence
  Description of Artificial Sequence: Synthetic peptide
TSSDVGGYNY

SEQ ID NO: 659 - protein, 3 aa, Artificial Sequence
  Description of Artificial Sequence: Synthetic peptide
DVS

SEQ ID NO: 660 - protein, 8 aa, Artificial Sequence
  Description of Artificial Sequence: Synthetic peptide
YTSSSTLY

SEQ ID NO: 661 - protein, 9 aa, Artificial Sequence
  Description of Artificial Sequence: Synthetic peptide
SSDVGGYNY

SEQ ID NO: 662 - protein, 3 aa, Artificial Sequence
  Description of Artificial Sequence: Synthetic peptide
DVS

SEQ ID NO: 663 - protein, 11 aa, Artificial Sequence
  Description of Artificial Sequence: Synthetic peptide
SSYTSSSTLYV

SEQ ID NO: 664 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVL

SEQ ID NO: 665 - DNA, 333 bp, Artificial Sequence
  Description of Artificial Sequence: Synthetic polynucleotide
cagtccgcgctgacccagcccgcctctgtgtccggatcaccgggacagtcgatcacgatctcctgcactggcacctcgtccgacgtgggaggttacaactacgtgtcgtggtaccagcagcatccaggaaaggccccgaagctcatgatctacgacgtgtcaaaccggccttcgggggtgtcaaacagattctcgggctccaagtccggaaataccgcatccctgaccattagcggcctgcaggcggaggacgaagccgactactattgctcctcgtacacctcgagctccactctgtacgtgttcggcactgggaccaaagtcaccgtgctc

SEQ ID NO: 666 - protein, 15 aa, Artificial Sequence
  Description of Artificial Sequence: Synthetic peptide
GGGGSGGGGSGGGGS

SEQ ID NO: 667 - protein, 253 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVL

SEQ ID NO: 668 - DNA, 759 bp, Artificial Sequence
  Description of Artificial Sequence: Synthetic polynucleotide
gaagtccaattgcaacagtccggtcctggcctcgtcaagccctcccaaaccctctccctgacttgcgccatctccggggattccgtgctgagcaactccgacacctggaactggattcggcagagcccgtccagaggcctggagtggctgggcaggacctaccaccggagcacttggtacgacgactacgccagctccgtgcgcggacgcgtgtcaatcaatgtggacacctccaagaaccagtacagcctgcaacttaacgctgtgactcccgaggatactggagtgtactattgtgcccgcgaccggctgcaggatggaaacagctggtccgatgccttcgatgtctggggacagggtaccatggtcacagtgtccagcggggggggcggatcaggcggcggtggctccggaggagggggttcccagtccgcgctgacccagcccgcctctgtgtccggatcaccgggacagtcgatcacgatctcctgcactggcacctcgtccgacgtgggaggttacaactacgtgtcgtggtaccagcagcatccaggaaaggccccgaagctcatgatctacgacgtgtcaaaccggccttcgggggtgtcaaacagattctcgggctccaagtccggaaataccgcatccctgaccattagcggcctgcaggcggaggacgaagccgactactattgctcctcgtacacctcgagctccactctgtacgtgttcggcactgggaccaaagtcaccgtgctc

SEQ ID NO: 669 - protein, 7 aa, Artificial Sequence
  Description of Artificial Sequence: Synthetic peptide
SNSDTWN

SEQ ID NO: 670 - protein, 18 aa, Artificial Sequence
  Description of Artificial Sequence: Synthetic peptide
RTYHRSTWYDDYASSVRG

SEQ ID NO: 671 - protein, 15 aa, Artificial Sequence
  Description of Artificial Sequence: Synthetic peptide
DRLQDGNSWSDAFDV

SEQ ID NO: 672 - protein, 9 aa, Artificial Sequence
  Description of Artificial Sequence: Synthetic peptide
GDSVLSNSD

SEQ ID NO: 673 - protein, 7 aa, Artificial Sequence
  Description of Artificial Sequence: Synthetic peptide
YHRSTWY

SEQ ID NO: 674 - protein, 15 aa, Artificial Sequence
  Description of Artificial Sequence: Synthetic peptide
DRLQDGNSWSDAFDV

SEQ ID NO: 675 - protein, 10 aa, Artificial Sequence
  Description of Artificial Sequence: Synthetic peptide
GDSVLSNSDT

SEQ ID NO: 676 - protein, 9 aa, Artificial Sequence
  Description of Artificial Sequence: Synthetic peptide
TYHRSTWYD

SEQ ID NO: 677 - protein, 17 aa, Artificial Sequence
  Description of Artificial Sequence: Synthetic peptide
ARDRLQDGNSWSDAFDV

SEQ ID NO: 678 - protein, 127 aa, Artificial Sequence; identical to SEQ ID NO: 578
  Description of Artificial Sequence: Synthetic polypeptide

SEQ ID NO: 679 - DNA, 381 bp, Artificial Sequence; identical to SEQ ID NO: 579
  Description of Artificial Sequence: Synthetic polynucleotide

SEQ ID NO: 680 - protein, 14 aa, Artificial Sequence
  Description of Artificial Sequence: Synthetic peptide
TGTSSDVGGYNYVS

SEQ ID NO: 681 - protein, 7 aa, Artificial Sequence
  Description of Artificial Sequence: Synthetic peptide
EVSNRPS

SEQ ID NO: 682 - protein, 11 aa, Artificial Sequence
  Description of Artificial Sequence: Synthetic peptide
SSYTSSSTLYI

SEQ ID NO: 683 - protein, 10 aa, Artificial Sequence
  Description of Artificial Sequence: Synthetic peptide
TSSDVGGYNY

SEQ ID NO: 684 - protein, 3 aa, Artificial Sequence
  Description of Artificial Sequence: Synthetic peptide
EVS

SEQ ID NO: 685 - protein, 8 aa, Artificial Sequence
  Description of Artificial Sequence: Synthetic peptide
YTSSSTLY

SEQ ID NO: 686 - protein, 9 aa, Artificial Sequence
  Description of Artificial Sequence: Synthetic peptide
SSDVGGYNY

SEQ ID NO: 687 - protein, 3 aa, Artificial Sequence
  Description of Artificial Sequence: Synthetic peptide
EVS

SEQ ID NO: 688 - protein, 11 aa, Artificial Sequence
  Description of Artificial Sequence: Synthetic peptide
SSYTSSSTLYI

SEQ ID NO: 689 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYIFGTGTKVTVL

SEQ ID NO: 690 - DNA, 333 bp, Artificial Sequence
  Description of Artificial Sequence: Synthetic polynucleotide
cagtccgcgctgacccagcccgcctctgtgtccggatcaccgggacagtcgatcacgatctcctgcactggcacctcgtccgacgtgggaggttacaactacgtgtcgtggtaccagcagcatccaggaaaggccccgaagctcatgatctacgaagtgtcaaaccggccttcgggggtgtcaaacagattctcgggctccaagtccggaaataccgcatccctgaccattagcggcctgcaggcggaggacgaagccgactactattgctcctcgtacacctcgagctccactctgtacattttcggcactgggaccaaagtcaccgtgctc

SEQ ID NO: 691 - protein, 15 aa, Artificial Sequence
  Description of Artificial Sequence: Synthetic peptide
GGGGSGGGGSGGGGS

SEQ ID NO: 692 - protein, 253 aa, Artificial Sequence
  Description of Artificial Sequence: Synthetic polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYIFGTGTKVTVL

SEQ ID NO: 693 - DNA, 759 bp, Artificial Sequence
  Description of Artificial Sequence: Synthetic polynucleotide
gaagtccaattgcaacagtccggtcctggcctcgtcaagccctcccaaaccctctccctgacttgcgccatctccggggattccgtgctgagcaactccgacacctggaactggattcggcagagcccgtccagaggcctggagtggctgggcaggacctaccaccggagcacttggtacgacgactacgccagctccgtgcgcggacgcgtgtcaatcaatgtggacacctccaagaaccagtacagcctgcaacttaacgctgtgactcccgaggatactggagtgtactattgtgcccgcgaccggctgcaggatggaaacagctggtccgatgccttcgatgtctggggacagggtaccatggtcacagtgtccagcggggggggcggatcaggcggcggtggctccggaggagggggttcccagtccgcgctgacccagcccgcctctgtgtccggatcaccgggacagtcgatcacgatctcctgcactggcacctcgtccgacgtgggaggttacaactacgtgtcgtggtaccagcagcatccaggaaaggccccgaagctcatgatctacgaagtgtcaaaccggccttcgggggtgtcaaacagattctcgggctccaagtccggaaataccgcatccctgaccattagcggcctgcaggcggaggacgaagccgactactattgctcctcgtacacctcgagctccactctgtacattttcggcactgggaccaaagtcaccgtgctc

SEQ ID NO: 694 - protein, 7 aa, Artificial Sequence
  Description of Artificial Sequence: Synthetic peptide
SNSDTWN

SEQ ID NO: 695 - protein, 18 aa, Artificial Sequence
  Description of Artificial Sequence: Synthetic peptide
RTYHRSTWYDDYASSVRG

SEQ ID NO: 696 - protein, 15 aa, Artificial Sequence
  Description of Artificial Sequence: Synthetic peptide
VRLQDGNSWSDAFDV

SEQ ID NO: 697 - protein, 9 aa, Artificial Sequence
  Description of Artificial Sequence: Synthetic peptide
GDSVLSNSD

SEQ ID NO: 698 - protein, 7 aa, Artificial Sequence
  Description of Artificial Sequence: Synthetic peptide
YHRSTWY

SEQ ID NO: 699 - protein, 15 aa, Artificial Sequence
  Description of Artificial Sequence: Synthetic peptide
VRLQDGNSWSDAFDV

SEQ ID NO: 700 - protein, 10 aa, Artificial Sequence
  Description of Artificial Sequence: Synthetic peptide
GDSVLSNSDT

SEQ ID NO: 701 - protein, 9 aa, Artificial Sequence
  Description of Artificial Sequence: Synthetic peptide
TYHRSTWYD

SEQ ID NO: 702 - protein, 17 aa, Artificial Sequence
  Description of Artificial Sequence: Synthetic peptide
ARVRLQDGNSWSDAFDV

SEQ ID NO: 703 - protein, 127 aa, Artificial Sequence
  Description of Artificial Sequence: Synthetic polypeptide
EVQLQQSGPGLVKPSQTLPLTCAISGDSVLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 704 - DNA, 381 bp, Artificial Sequence
  Description of Artificial Sequence: Synthetic polynucleotide
gaagtgcagcttcaacaatcaggacccggactcgtcaaaccatcgcagaccctccctctcacttgcgccatctccggggactccgtgctgtccaactccgacacttggaactggattcggcagagcccgtccagaggattggaatggctgggaaggacctatcaccggtccacttggtacgacgattacgcctcgtccgtgcgcggtcgggtgtccatcaacgtggacacctccaagaaccagtactccctgcaactgaacgccgtgacccctgaggacactggggtgtactactgtgcgagagtgcggctgcaggatgggaactcttggtccgacgccttcgatgtctggggccagggcaccatggtcactgtgtcatcc

SEQ ID NO: 705 - protein, 14 aa, Artificial Sequence
  Description of Artificial Sequence: Synthetic peptide
TGTSSDVGGYNYVS

SEQ ID NO: 706 - protein, 7 aa, Artificial Sequence
  Description of Artificial Sequence: Synthetic peptide
DVSNRPS

SEQ ID NO: 707 - protein, 11 aa, Artificial Sequence
  Description of Artificial Sequence: Synthetic peptide
SSYTSSSTLYV

SEQ ID NO: 708 - protein, 10 aa, Artificial Sequence
  Description of Artificial Sequence: Synthetic peptide
TSSDVGGYNY

SEQ ID NO: 709 - protein, 3 aa, Artificial Sequence
  Description of Artificial Sequence: Synthetic peptide
DVS

SEQ ID NO: 710 - protein, 8 aa, Artificial Sequence
  Description of Artificial Sequence: Synthetic peptide
YTSSSTLY

SEQ ID NO: 711 - protein, 9 aa, Artificial Sequence
  Description of Artificial Sequence: Synthetic peptide
SSDVGGYNY

SEQ ID NO: 712 - protein, 3 aa, Artificial Sequence
  Description of Artificial Sequence: Synthetic peptide
DVS

SEQ ID NO: 713 - protein, 11 aa, Artificial Sequence
  Description of Artificial Sequence: Synthetic peptide
SSYTSSSTLYV

SEQ ID NO: 714 - protein, 111 aa, Artificial Sequence
  Description of Artificial Sequence: Synthetic polypeptide
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 715 - DNA, 333 bp, Artificial Sequence
  Description of Artificial Sequence: Synthetic polynucleotide
cagtcggcactgacccagcctgcctcagcctccgggagcccgggacagtccgtgaccatttcctgcaccgggacctcctccgacgtgggaggctacaactacgtgtcatggtaccagcagcaccccggaaaggcaccgaagctgatgatctacgacgtgtccaaccgcccgagcggggtgtcaaatcgcttctcgggctcgaagtcgggaaacacagcgagcctgacgatctcgggactgcaagccgaagatgaggctgactactactgctcgtcctacactagctccagcaccctctacgtgttcggtactggtacccagctgaccgtcctg

SEQ ID NO: 716 - protein, 15 aa, Artificial Sequence
  Description of Artificial Sequence: Synthetic peptide
GGGGSGGGGSGGGGP

SEQ ID NO: 717 - protein, 253 aa, Artificial Sequence
  Description of Artificial Sequence: Synthetic polypeptide
EVQLQQSGPGLVKPSQTLPLTCAISGDSVLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 718 - DNA, 759 bp, Artificial Sequence
  Description of Artificial Sequence: Synthetic polynucleotide
gaagtgcagcttcaacaatcaggacccggactcgtcaaaccatcgcagaccctccctctcacttgcgccatctccggggactccgtgctgtccaactccgacacttggaactggattcggcagagcccgtccagaggattggaatggctgggaaggacctatcaccggtccacttggtacgacgattacgcctcgtccgtgcgcggtcgggtgtccatcaacgtggacacctccaagaaccagtactccctgcaactgaacgccgtgacccctgaggacactggggtgtactactgtgcgagagtgcggctgcaggatgggaactcttggtccgacgccttcgatgtctggggccagggcaccatggtcactgtgtcatccggcggtggtggcagcggcggaggcggcagcggaggcggaggaccccagtcggcactgacccagcctgcctcagcctccgggagcccgggacagtccgtgaccatttcctgcaccgggacctcctccgacgtgggaggctacaactacgtgtcatggtaccagcagcaccccggaaaggcaccgaagctgatgatctacgacgtgtccaaccgcccgagcggggtgtcaaatcgcttctcgggctcgaagtcgggaaacacagcgagcctgacgatctcgggactgcaagccgaagatgaggctgactactactgctcgtcctacactagctccagcaccctctacgtgttcggtactggtacccagctgaccgtcctg

SEQ ID NO: 719 - protein, 7 aa, Artificial Sequence
  Description of Artificial Sequence: Synthetic peptide
SNSDTWN

SEQ ID NO: 720 - protein, 18 aa, Artificial Sequence
  Description of Artificial Sequence: Synthetic peptide
RTYHRSTWYDDYASSVRG

SEQ ID NO: 721 - protein, 15 aa, Artificial Sequence
  Description of Artificial Sequence: Synthetic peptide
VRLQDGNSWSDAFDV

SEQ ID NO: 722 - protein, 9 aa, Artificial Sequence
  Description of Artificial Sequence: Synthetic peptide
GDSMLSNSD

SEQ ID NO: 723 - protein, 7 aa, Artificial Sequence
  Description of Artificial Sequence: Synthetic peptide
YHRSTWY

SEQ ID NO: 724 - protein, 15 aa, Artificial Sequence
  Description of Artificial Sequence: Synthetic peptide
VRLQDGNSWSDAFDV

SEQ ID NO: 725 - protein, 10 aa, Artificial Sequence
  Description of Artificial Sequence: Synthetic peptide
GDSMLSNSDT

SEQ ID NO: 726 - protein, 9 aa, Artificial Sequence
  Description of Artificial Sequence: Synthetic peptide
TYHRSTWYD

SEQ ID NO: 727 - protein, 17 aa, Artificial Sequence
  Description of Artificial Sequence: Synthetic peptide
ARVRLQDGNSWSDAFDV

SEQ ID NO: 728 - protein, 127 aa, Artificial Sequence
  Description of Artificial Sequence: Synthetic polypeptide
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 729 - DNA, 381 bp, Artificial Sequence
  Description of Artificial Sequence: Synthetic polynucleotide
gaagtgcagcttcaacaatcaggacccggactcgtcaaaccatcgcagaccctcagcctcacttgcgccatctccggggactccatgctgtccaactccgacacttggaactggattcggcagagcccgtccagaggattggaatggctgggaaggacctatcaccggtccacttggtacgacgattacgcctcgtccgtgcgcggtcgggtgtccatcaacgtggacacctccaagaaccagtactccctgcaactgaacgccgtgacccctgaggacactggggtgtactactgtgcgagagtgcggctgcaggatgggaactcttggtccgacgccttcgatgtctggggccagggcaccatggtcactgtgtcatcc

SEQ ID NO: 730 - protein, 14 aa, Artificial Sequence
  Description of Artificial Sequence: Synthetic peptide
TGTSSDVGGYNYVS

SEQ ID NO: 731 - protein, 7 aa, Artificial Sequence
  Description of Artificial Sequence: Synthetic peptide
DVSNRPS

SEQ ID NO: 732 - protein, 11 aa, Artificial Sequence
  Description of Artificial Sequence: Synthetic peptide
SSYTSSSTLYV

SEQ ID NO: 733 - protein, 10 aa, Artificial Sequence
  Description of Artificial Sequence: Synthetic peptide
TSSDVGGYNY

SEQ ID NO: 734 - protein, 3 aa, Artificial Sequence
  Description of Artificial Sequence: Synthetic peptide
DVS

SEQ ID NO: 735 - protein, 8 aa, Artificial Sequence
  Description of Artificial Sequence: Synthetic peptide
YTSSSTLY

SEQ ID NO: 736 - protein, 9 aa, Artificial Sequence
  Description of Artificial Sequence: Synthetic peptide
SSDVGGYNY

SEQ ID NO: 737 - protein, 3 aa, Artificial Sequence
  Description of Artificial Sequence: Synthetic peptide
DVS

SEQ ID NO: 738 - protein, 11 aa, Artificial Sequence
  Description of Artificial Sequence: Synthetic peptide
SSYTSSSTLYV

SEQ ID NO: 739 - protein, 111 aa, Artificial Sequence; identical to SEQ ID NO: 714
  Description of Artificial Sequence: Synthetic polypeptide

SEQ ID NO: 740 - DNA, 333 bp, Artificial Sequence; identical to SEQ ID NO: 715
  Description of Artificial Sequence: Synthetic polynucleotide

SEQ ID NO: 741 - protein, 15 aa, Artificial Sequence
  Description of Artificial Sequence: Synthetic peptide
GGGGSGGGGSGGGGS

SEQ ID NO: 742 - protein, 253 aa, Artificial Sequence
  Description of Artificial Sequence: Synthetic polypeptide
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 743 - DNA, 759 bp, Artificial Sequence
  Description of Artificial Sequence: Synthetic polynucleotide
gaagtgcagcttcaacaatcaggacccggactcgtcaaaccatcgcagaccctcagcctcacttgcgccatctccggggactccatgctgtccaactccgacacttggaactggattcggcagagcccgtccagaggattggaatggctgggaaggacctatcaccggtccacttggtacgacgattacgcctcgtccgtgcgcggtcgggtgtccatcaacgtggacacctccaagaaccagtactccctgcaactgaacgccgtgacccctgaggacactggggtgtactactgtgcgagagtgcggctgcaggatgggaactcttggtccgacgccttcgatgtctggggccagggcaccatggtcactgtgtcatccggcggtggtggcagcggcggaggcggcagcggaggcggaggaagccagtcggcactgacccagcctgcctcagcctccgggagcccgggacagtccgtgaccatttcctgcaccgggacctcctccgacgtgggaggctacaactacgtgtcatggtaccagcagcaccccggaaaggcaccgaagctgatgatctacgacgtgtccaaccgcccgagcggggtgtcaaatcgcttctcgggctcgaagtcgggaaacacagcgagcctgacgatctcgggactgcaagccgaagatgaggctgactactactgctcgtcctacactagctccagcaccctctacgtgttcggtactggtacccagctgaccgtcctg

SEQ ID NO: 744 - protein, 497 aa, Artificial Sequence
  Description of Artificial Sequence: Synthetic polypeptide
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 745 - DNA, 1491 bp, Artificial Sequence
  Description of Artificial Sequence: Synthetic polynucleotide
atggccctccctgtcaccgccctgctgcttccgctggctcttctgctccacgccgctcggcccgaagtgcagcttcaacaatcaggacccggactcgtcaaaccatcgcagaccctcagcctcacttgcgccatctccggggactccatgctgtccaactccgacacttggaactggattcggcagagcccgtccagaggattggaatggctgggaaggacctatcaccggtccacttggtacgacgattacgcctcgtccgtgcgcggtcgggtgtccatcaacgtggacacctccaagaaccagtactccctgcaactgaacgccgtgacccctgaggacactggggtgtactactgtgcgagagtgcggctgcaggatgggaactcttggtccgacgccttcgatgtctggggccagggcaccatggtcactgtgtcatccggcggtggtggcagcggcggaggcggcagcggaggcggaggaagccagtcggcactgacccagcctgcctcagcctccgggagcccgggacagtccgtgaccatttcctgcaccgggacctcctccgacgtgggaggctacaactacgtgtcatggtaccagcagcaccccggaaaggcaccgaagctgatgatctacgacgtgtccaaccgcccgagcggggtgtcaaatcgcttctcgggctcgaagtcgggaaacacagcgagcctgacgatctcgggactgcaagccgaagatgaggctgactactactgctcgtcctacactagctccagcaccctctacgtgttcggtactggtacccagctgaccgtcctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 746 - protein, 7 aa, Artificial Sequence
  Description of Artificial Sequence: Synthetic peptide
SNSAAWN

SEQ ID NO: 747 - protein, 18 aa, Artificial Sequence
  Description of Artificial Sequence: Synthetic peptide
RTYYRSKWYSDYAVSVKS

SEQ ID NO: 748 - protein, 15 aa, Artificial Sequence
  Description of Artificial Sequence: Synthetic peptide
DPYDFWSGYPDAFDI

SEQ ID NO: 749 - protein, 9 aa, Artificial Sequence
  Description of Artificial Sequence: Synthetic peptide
GDSVSSNSA

SEQ ID NO: 750 - protein, 7 aa, Artificial Sequence
  Description of Artificial Sequence: Synthetic peptide
YYRSKWY

SEQ ID NO: 751 - protein, 15 aa, Artificial Sequence
  Description of Artificial Sequence: Synthetic peptide
DPYDFWSGYPDAFDI

SEQ ID NO: 752 - protein, 127 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSS

SEQ ID NO: 753 - DNA, 381 bp, Artificial Sequence
  Description of Artificial Sequence: Synthetic polynucleotide
gaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtatagtgattatgcagtatctgtgaaaagtcgaataaccatcaacccagacacatccaagaaccagttctccctgcagctgaactctgtgactcccgaggacacggctgtgtattactgtgcaagagatccttacgatttttggagtggttatcctgatgcttttgatatctggggccaagggacaatggtcaccgtctcttca

SEQ ID NO: 754 - protein, 14 aa, Artificial Sequence
  Description of Artificial Sequence: Synthetic peptide
TGTSSDVGGYNYVS

SEQ ID NO: 755 - protein, 7 aa, Artificial Sequence
  Description of Artificial Sequence: Synthetic peptide
EVNNRPS

SEQ ID NO: 756 - protein, 11 aa, Artificial Sequence
  Description of Artificial Sequence: Synthetic peptide
SSYTSGRTLYV

SEQ ID NO: 757 - protein, 10 aa, Artificial Sequence
  Description of Artificial Sequence: Synthetic peptide
TSSDVGGYNY

SEQ ID NO: 758 - protein, 3 aa, Artificial Sequence
  Description of Artificial Sequence: Synthetic peptide
EVN

SEQ ID NO: 759 - protein, 8 aa, Artificial Sequence
  Description of Artificial Sequence: Synthetic peptide
YTSGRTLY

SEQ ID NO: 760 - protein, 112 aa, Artificial Sequence
  Description of Artificial Sequence: Synthetic polypeptide
QSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 761 - DNA, 336 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttacaactatgtctcctggtaccaacagcacccaggcaaagcccccaaggtcataatttctgaggtcaataatcggccctcaggggtttctcatcgcttctctgggtccaagtctggcaacacggcctccctgaccatctctgggctccaggctgaggacgaggctgattatttctgcagctcatatacaagtggcaggactctttatgtcttcggaactgggagcaaggtcaccgtcctaggt

SEQ ID NO: 762 - protein, 15 aa, Artificial Sequence
  Description of Artificial Sequence: Synthetic peptide
GGGGSGGGGSGGGGS

SEQ ID NO: 763 - protein, 254 aa, Artificial Sequence
  Description of Artificial Sequence: Synthetic polypeptide
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 764 - protein, 486 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 765 - protein, 242 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 766 - protein, 244 aa, Artificial Sequence
  Description of Artificial Sequence: Synthetic polypeptide
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRS

SEQ ID NO: 767 - protein, 464 aa, Artificial Sequence
  Description of Artificial Sequence: Synthetic polypeptide
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 768 - protein, 246 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSE

SEQ ID NO: 769 - protein, 439 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRL

SEQ ID NO: 770 - protein, 819 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 771 - protein, 245 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 772 - protein, 467 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 773 - protein, 5 aa, Artificial Sequence
  Description of Artificial Sequence: Synthetic peptide
DYGVS

SEQ ID NO: 774 - protein, 16 aa, Artificial Sequence
  Description of Artificial Sequence: Synthetic peptide
VIWGSETTYYNSALKS

SEQ ID NO: 775 - protein, 12 aa, Artificial Sequence
  Description of Artificial Sequence: Synthetic peptide
HYYYGGSYAMDY

SEQ ID NO: 776 - protein, 11 aa, Artificial Sequence
  Description of Artificial Sequence: Synthetic peptide
RASQDISKYLN

SEQ ID NO: 777 - protein, 7 aa, Artificial Sequence
  Description of Artificial Sequence: Synthetic peptide
HTSRLHS

SEQ ID NO: 778 - protein, 9 aa, Artificial Sequence
  Description of Artificial Sequence: Synthetic peptide
QQGNTLPYT

SEQ ID NO: 779 - protein, 5 aa, Artificial Sequence
  Description of Artificial Sequence: Synthetic peptide
DYGVS

SEQ ID NO: 780 - protein, 16 aa, Artificial Sequence
  Description of Artificial Sequence: Synthetic peptide
VIWGSETTYYSSSLKS

SEQ ID NO: 781 - protein, 12 aa, Artificial Sequence
  Description of Artificial Sequence: Synthetic peptide
HYYYGGSYAMDY

SEQ ID NO: 782 - protein, 11 aa, Artificial Sequence
  Description of Artificial Sequence: Synthetic peptide
RASQDISKYLN

SEQ ID NO: 783 - protein, 7 aa, Artificial Sequence
  Description of Artificial Sequence: Synthetic peptide
HTSRLHS

SEQ ID NO: 784 - protein, 9 aa, Artificial Sequence
  Description of Artificial Sequence: Synthetic peptide
QQGNTLPYT

SEQ ID NO: 785 - protein, 5 aa, Artificial Sequence
  Description of Artificial Sequence: Synthetic peptide
DYGVS

SEQ ID NO: 786 - protein, 16 aa, Artificial Sequence
  Description of Artificial Sequence: Synthetic peptide
VIWGSETTYYQSSLKS

SEQ ID NO: 787 - protein, 12 aa, Artificial Sequence
  Description of Artificial Sequence: Synthetic peptide
HYYYGGSYAMDY

SEQ ID NO: 788 - protein, 11 aa, Artificial Sequence
  Description of Artificial Sequence: Synthetic peptide
RASQDISKYLN

SEQ ID NO: 789 - protein, 7 aa, Artificial Sequence
  Description of Artificial Sequence: Synthetic peptide
HTSRLHS

SEQ ID NO: 790 - protein, 9 aa, Artificial Sequence
  Description of Artificial Sequence: Synthetic peptide
QQGNTLPYT

SEQ ID NO: 791 - protein, 5 aa, Artificial Sequence
  Description of Artificial Sequence: Synthetic peptide
DYGVS

SEQ ID NO: 792 - protein, 16 aa, Artificial Sequence
  Description of Artificial Sequence: Synthetic peptide
VIWGSETTYYNSSLKS

SEQ ID NO: 793 - protein, 12 aa, Artificial Sequence
  Description of Artificial Sequence: Synthetic peptide
HYYYGGSYAMDY

SEQ ID NO: 794 - protein, 11 aa, Artificial Sequence
  Description of Artificial Sequence: Synthetic peptide
RASQDISKYLN

SEQ ID NO: 795 - protein, 7 aa, Artificial Sequence
  Description of Artificial Sequence: Synthetic peptide
HTSRLHS

SEQ ID NO: 796 - protein, 9 aa, Artificial Sequence
  Description of Artificial Sequence: Synthetic peptide
QQGNTLPYT

SEQ ID NO: 797 - protein, 21 aa, Artificial Sequence
  Description of Artificial Sequence: Synthetic peptide
MALPVTALLLPLALLLHAARP

SEQ ID NO: 798 - DNA, 63 bp, Artificial Sequence
  Description of Artificial Sequence: Synthetic oligonucleotide
atggccctccctgtcaccgccctgctgcttccgctggctcttctgctccacgccgctcggccc

SEQ ID NO: 799 - protein, 45 aa, Artificial Sequence
  Description of Artificial Sequence: Synthetic polypeptide
TTTPAPRPPTPAPTIASQPLSLRPEACRPAAGGAVHTRGLDFACD

SEQ ID NO: 800 - DNA, 135 bp, Artificial Sequence
  Description of Artificial Sequence: Synthetic polynucleotide
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 801 - protein, 24 aa, Artificial Sequence
  Description of Artificial Sequence: Synthetic peptide
IYIWAPLAGTCGVLLLSLVITLYC

SEQ ID NO: 802 - DNA, 72 bp, Artificial Sequence
  Description of Artificial Sequence: Synthetic oligonucleotide
atctacatttgggcccctctggctggtacttgcggggtcctgctgctttcactcgtgatcactctttactgt

SEQ ID NO: 803 - protein, 42 aa, Artificial Sequence
  Description of Artificial Sequence: Synthetic polypeptide
KRGRKKLLYIFKQPFMRPVQTTQEEDGCSCRFPEEEEGGCEL

SEQ ID NO: 804 - DNA, 126 bp, Artificial Sequence
  Description of Artificial Sequence: Synthetic polynucleotide
aagcgcggtcggaagaagctgctgtacatctttaagcaacccttcatgaggcctgtgcagactactcaagaggaggacggctgttcatgccggttcccagaggaggaggaaggcggctgcgaactg

SEQ ID NO: 805 - protein, 112 aa, Artificial Sequence
  Description of Artificial Sequence: Synthetic polypeptide
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 806 - DNA, 336 bp, Artificial Sequence
  Description of Artificial Sequence: Synthetic polynucleotide
cgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 807 - protein, 112 aa, Artificial Sequence
  Description of Artificial Sequence: Synthetic polypeptide
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 808 - DNA, 336 bp, Artificial Sequence
  Description of Artificial Sequence: Synthetic polynucleotide
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 809 - protein, 41 aa, Artificial Sequence
  Description of Artificial Sequence: Synthetic polypeptide
RSKRSRLLHSDYMNMTPRRPGPTRKHYQPYAPPRDFAAYRS

SEQ ID NO: 810 - DNA, 123 bp, Artificial Sequence
  Description of Artificial Sequence: Synthetic polynucleotide
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 811 - protein, 35 aa, Artificial Sequence
  Description of Artificial Sequence: Synthetic polypeptide
TKKKYSSSVHDPNGEYMFMRAVNTAKKSRLTDVTL

SEQ ID NO: 812 - DNA, 105 bp, Artificial Sequence
  Description of Artificial Sequence: Synthetic polynucleotide
acaaaaaagaagtattcatccagtgtgcacgaccctaacggtgaatacatgttcatgagagcagtgaacacagccaaaaaatccagactcacagatgtgacccta

SEQ ID NO: 813 - protein, 35 aa, Artificial Sequence
  Description of Artificial Sequence: Synthetic polypeptide
TKKKYSSSVHDPNGEFMFMRAVNTAKKSRLTDVTL

SEQ ID NO: 814 - protein, 230 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 815 - DNA, 690 bp, Artificial Sequence
  Description of Artificial Sequence: Synthetic polynucleotide
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 816 - protein, 282 aa, Artificial Sequence
  Description of Artificial Sequence: Synthetic polypeptide
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 817 - DNA, 847 bp, Artificial Sequence
  Description of Artificial Sequence: Synthetic polynucleotide
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 818 - protein, 48 aa, Artificial Sequence
  Description of Artificial Sequence: Synthetic polypeptide
QRRKYRSNKGESPVEPAEPCRYSCPREEEGSTIPIQEDYRKPEPACSP

SEQ ID NO: 819 - DNA, 123 bp, Artificial Sequence; identical to SEQ ID NO: 810
  Description of Artificial Sequence: Synthetic polynucleotide

SEQ ID NO: 820 - protein, 150 aa, Artificial Sequence [sequence omitted]

SEQ ID NO: 821 - DNA, 450 bp, Artificial Sequence
  Description of Artificial Sequence: Synthetic polynucleotide
cccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtc

SEQ ID NO: 822 - protein, 373 aa, Artificial Sequence
  Description of Artificial Sequence: Synthetic polypeptide
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 823 - DNA, 1119 bp, Artificial Sequence
  Description of Artificial Sequence: Synthetic polynucleotide
cccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 824 - protein, 132 aa, Artificial Sequence
  Description of Artificial Sequence: Synthetic polypeptide
DVPDYASLGGPSSPKKKRKVSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSY

SEQ ID NO: 825 - protein, 108 aa, Artificial Sequence
  Description of Artificial Sequence: Synthetic polypeptide
VQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 826 - protein, 93 aa, Artificial Sequence [sequence omitted]

SEQ ID NO: 827 - protein, 95 aa, Artificial Sequence
  Description of Artificial Sequence: Synthetic polypeptide
ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS

SEQ ID NO: 828 - protein, 95 aa, Artificial Sequence
  Description of Artificial Sequence: Synthetic polypeptide
ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS

SEQ ID NO: 829 - protein, 95 aa, Artificial Sequence
  Description of Artificial Sequence: Synthetic polypeptide
ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 830 - protein, 95 aa, Artificial Sequence
  Description of Artificial Sequence: Synthetic polypeptide
  MOD_RES (12)..(12): Any amino acid
  MOD_RES (78)..(78): Any amino acid
ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS

SEQ ID NO: 831 - protein, 95 aa, Artificial Sequence
  Description of Artificial Sequence: Synthetic polypeptide
ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS

SEQ ID NO: 832 - protein, 95 aa, Artificial Sequence
  Description of Artificial Sequence: Synthetic polypeptide
ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS

SEQ ID NO: 833 - DNA, 1184 bp, Artificial Sequence
  Description of Artificial Sequence: Synthetic polynucleotide
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 834 - protein, 5 aa, Artificial Sequence
  Description of Artificial Sequence: Synthetic peptide
GGGGS

SEQ ID NO: 835 - protein, 243 aa, Artificial Sequence
  Description of Artificial Sequence: Synthetic polypeptide
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 836 - protein, 238 aa, Artificial Sequence
  Description of Artificial Sequence: Synthetic polypeptide
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 837 - protein, 243 aa, Artificial Sequence
  Description of Artificial Sequence: Synthetic polypeptide
EVQLQQSGPGLVKPSQTLSLTCAISGDSMLSNSDTWNWIRKSPSRGLEWLGRTYHRSTWYDDYASSVRGRVSINVDTSKNQYSLQLNAVTPEDTGVYYCARVRLQDGNSWSDAFDVWGQGTMVTVSSGGGGSQSALTQPASASGSPGQSVTISCTGTSSDVGGYNYVSWYQDHPGKAPKLMIYDVSNRPSGVSNRFSGSKSGNTASLTISGLQAEDEADYYCSSYTSSSTLYVFGTGTQLTVL

SEQ ID NO: 838 - protein, 7 aa, Artificial Sequence
  Description of Artificial Sequence: Synthetic peptide
LAEAAAK

SEQ ID NO: 839 - protein, 127 aa, Artificial Sequence
  Description of Artificial Sequence: Synthetic polypeptide
EVQLQQSGPGLVKPSQTLSLTCAISGDSMLSNSDTWNWIRKSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 840 - protein, 111 aa, Artificial Sequence
  Description of Artificial Sequence: Synthetic polypeptide
QSALTQPASASGSPGQSVTISCTGTSSDVGGYNYVSWYQDHPGKAPKLMIYDVSNRPSGVSNRFSGSKSGNTASLTISGLQAEDEADYYCSSYTSSSTLYVFGTGTQLTVL

SEQ ID NO: 841 - protein, 15 aa, Artificial Sequence
  Description of Artificial Sequence: Synthetic peptide
GGGGSGGGGSGGGGS

SEQ ID NO: 842-843 - skipped (2 entries)

SEQ ID NO: 844 - DNA, 2241 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcttggcagaagccgccgcgaaagaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctgggggcggtggatcgggtggcgggggttcggggggcggcggctctcagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 845 - protein, 746 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSLAEAAAKEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 846 - DNA, 2235 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcggagggggagggagtgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctgggggcggtggatcgggtggcgggggttcggggggcggcggctctcagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 847 - protein, 744 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 848 - DNA, 2211 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcttggcagaagccgccgcgaaagaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctggcggaggaggctcccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 849 - protein, 736 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSLAEAAAKEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 850 - DNA, 2205 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcggagggggagggagtgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctggcggaggaggctcccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 851 - protein, 734 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 852 - DNA, 2241 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcttggcagaagccgccgcgaaacagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctggggggcggtggatcgggtggcgggggttcggggggcggcggctctgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 853 - protein, 746 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSLAEAAAKQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSGGGGSGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 854 - DNA, 2235 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcggagggggagggagtcagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctggggggcggtggatcgggtggcgggggttcggggggcggcggctctgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 855 - protein, 744 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSGGGGSGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 856 - DNA, 2211 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcttggcagaagccgccgcgaaacagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgggcggaggaggctccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 857 - protein, 736 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSLAEAAAKQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 858 - protein, 734 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 859 - DNA, 2241 bp, Artificial Sequence
  Description of Artificial Sequence: Synthetic polynucleotide
atggccctccctgtcaccgccctgctgcttccgctggctcttctgctccacgccgctcggcccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctgggggcggtggatcgggtggcgggggttcggggggcggcggctctcagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgttggcagaagccgccgcgaaagaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 860 - protein, 746 aa, Artificial Sequence
  Description of Artificial Sequence: Synthetic polypeptide
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLAEAAAKEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 861 - DNA, 2235 bp, Artificial Sequence
  Description of Artificial Sequence: Synthetic polynucleotide
atggccctccctgtcaccgccctgctgcttccgctggctcttctgctccacgccgctcggcccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctgggggcggtggatcgggtggcgggggttcggggggcggcggctctcagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgggagggggagggagtgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 862 - protein, 744 aa, Artificial Sequence
  Description of Artificial Sequence: Synthetic polypeptide
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 863 - DNA, 2211 bp, Artificial Sequence
  Description of Artificial Sequence: Synthetic polynucleotide
atggccctccctgtcaccgccctgctgcttccgctggctcttctgctccacgccgctcggcccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctggcggaggaggctcccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgttggcagaagccgccgcgaaagaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 864 - protein, 736 aa, Artificial Sequence
  Description of Artificial Sequence: Synthetic polypeptide
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLAEAAAKEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 865 - DNA, 2205 bp, Artificial Sequence
  Description of Artificial Sequence: Synthetic polynucleotide
atggccctccctgtcaccgccctgctgcttccgctggctcttctgctccacgccgctcggcccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctggcggaggaggctcccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgggagggggagggagtgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 866 - protein, 734 aa, Artificial Sequence
  Description of Artificial Sequence: Synthetic polypeptide
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 867 - DNA, 2241 bp, Artificial Sequence
  Description of Artificial Sequence: Synthetic polynucleotide
atggccctccctgtcaccgccctgctgcttccgctggctcttctgctccacgccgctcggccccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctggggggcggtggatcgggtggcgggggttcggggggcggcggctctgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctttggcagaagccgccgcgaaagaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 868 - protein, 746 aa, Artificial Sequence
  Description of Artificial Sequence: Synthetic polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSGGGGSGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSLAEAAAKEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 869 - DNA, 2235 bp, Artificial Sequence
  Description of Artificial Sequence: Synthetic polynucleotide
atggccctccctgtcaccgccctgctgcttccgctggctcttctgctccacgccgctcggccccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctggggggcggtggatcgggtggcgggggttcggggggcggcggctctgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctggagggggagggagtgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 870 - protein, 744 aa, Artificial Sequence
  Description of Artificial Sequence: Synthetic polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSGGGGSGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 871 - DNA, 2211 bp, Artificial Sequence
  Description of Artificial Sequence: Synthetic polynucleotide
atggccctccctgtcaccgccctgctgcttccgctggctcttctgctccacgccgctcggccccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgggcggaggaggctccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctttggcagaagccgccgcgaaagaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 872 - protein, 736 aa, Artificial Sequence
  Description of Artificial Sequence: Synthetic polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSLAEAAAKEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 873 - DNA, 2205 bp, Artificial Sequence
  Description of Artificial Sequence: Synthetic polynucleotide
atggccctccctgtcaccgccctgctgcttccgctggctcttctgctccacgccgctcggccccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgggcggaggaggctccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctggagggggagggagtgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 874 - protein, 734 aa, Artificial Sequence
  Description of Artificial Sequence: Synthetic polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 875 - protein, 5 aa, Artificial Sequence
  Description of Artificial Sequence: Synthetic peptide
GGGGS

SEQ ID NO: 876 - protein, 7 aa, Artificial Sequence
  Description of Artificial Sequence: Synthetic peptide
LAEAAAK

SEQ ID NO: 877 - DNA, 63 bp, Artificial Sequence; identical to SEQ ID NO: 798
  Description of Artificial Sequence: Synthetic oligonucleotide

SEQ ID NO: 878 - protein, 21 aa, Artificial Sequence
  Description of Artificial Sequence: Synthetic peptide
MALPVTALLLPLALLLHAARP

SEQ ID NO: 879 - DNA, 726 bp, Artificial Sequence
  Description of Artificial Sequence: Synthetic polynucleotide
gaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagc

SEQ ID NO: 880 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 881 - DNA, 759 bp, Artificial Sequence
  Description of Artificial Sequence: Synthetic polynucleotide
gaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctgggggcggtggatcgggtggcgggggttcggggggcggcggctctcagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctg

SEQ ID NO: 882 - protein, 253 aa, Artificial Sequence; identical to SEQ ID NO: 742
  Description of Artificial Sequence: Synthetic polypeptide

SEQ ID NO: 883 - DNA, 729 bp, Artificial Sequence
  Description of Artificial Sequence: Synthetic polynucleotide
gaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctggcggaggaggctcccagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctg

SEQ ID NO: 884 - protein, 243 aa, Artificial Sequence; identical to SEQ ID NO: 835
  Description of Artificial Sequence: Synthetic polypeptide

SEQ ID NO: 885 - DNA, 759 bp, Artificial Sequence
  Description of Artificial Sequence: Synthetic polynucleotide
cagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctggggggcggtggatcgggtggcgggggttcggggggcggcggctctgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtct

SEQ ID NO: 886 - protein, 253 aa, Artificial Sequence
  Description of Artificial Sequence: Synthetic polypeptide
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSGGGGSGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 887 - DNA, 729 bp, Artificial Sequence
  Description of Artificial Sequence: Synthetic polynucleotide
cagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgggcggaggaggctccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtct

SEQ ID NO: 888 - protein, 243 aa, Artificial Sequence
  Description of Artificial Sequence: Synthetic polypeptide
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 889 - DNA, 207 bp, Artificial Sequence
  Description of Artificial Sequence: Synthetic polynucleotide
accactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgt

SEQ ID NO: 890 - protein, 69 aa, Artificial Sequence
  Description of Artificial Sequence: Synthetic polypeptide
TTTPAPRPPTPAPTIASQPLSLRPEACRPAAGGAVHTRGLDFACDIYIWAPLAGTCGVLLLSLVITLYC

SEQ ID NO: 891 - DNA, 126 bp, Artificial Sequence; identical to SEQ ID NO: 804
  Description of Artificial Sequence: Synthetic polynucleotide

SEQ ID NO: 892 - protein, 42 aa, Artificial Sequence; identical to SEQ ID NO: 803
  Description of Artificial Sequence: Synthetic polypeptide

SEQ ID NO: 893 - DNA, 339 bp, Artificial Sequence
  Description of Artificial Sequence: Synthetic polynucleotide
cgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 894 - protein, 112 aa, Artificial Sequence; identical to SEQ ID NO: 807
  Description of Artificial Sequence: Synthetic polypeptide

SEQ ID NO: 895 - DNA, 2205 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcggagggggagggagtcagtccgctcttacccaaccggcctcagcctcggggagccccggccagagcgtgaccatttcctgcaccggcacttcatccgacgtgggcggctacaactacgtgtcctggtaccaacagcacccgggaaaggcccccaagctcatgatctacgacgtgtccaacaggccctcgggagtgtccaaccggttctcgggttcgaaatcgggaaacacagccagcctgaccatcagcggactgcaggctgaagatgaagccgactactactgctcctcctacacctcgtcatccacgctctacgtgttcggcactggaactcagctgactgtgctgggcggaggaggctccgaagtgcagcttcaacaatcaggaccaggactcgtcaaaccatcacagaccctctccctcacatgtgccatctccggggactccatgttgagcaattccgacacttggaattggattagacaaagcccgtcccggggtctggaatggttgggacgcacctaccaccggtctacttggtacgacgactacgcgtcatccgtgcggggaagagtgtccatcaacgtggacacctccaagaaccagtacagcctgcagcttaatgccgtgactcctgaggatacgggcgtctactactgcgcccgcgtccgcctgcaagacgggaacagctggagcgatgcattcgatgtctggggccagggaactatggtcaccgtgtcgtctaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaa

SEQ ID NO: 896 - protein, 10 aa, Artificial Sequence
  Description of Artificial Sequence: Synthetic peptide
GYTFTNYWMH

SEQ ID NO: 897 - protein, 17 aa, Artificial Sequence
  Description of Artificial Sequence: Synthetic peptide
FITPTTGYPEYNQKFKD

SEQ ID NO: 898 - protein, 13 aa, Artificial Sequence
  Description of Artificial Sequence: Synthetic peptide
RKVGKGVYYALDY

SEQ ID NO: 899 - protein, 11 aa, Artificial Sequence
  Description of Artificial Sequence: Synthetic peptide
RASGNIHNYLA

SEQ ID NO: 900 - protein, 7 aa, Artificial Sequence
  Description of Artificial Sequence: Synthetic peptide
NTKTLAD

SEQ ID NO: 901 - protein, 9 aa, Artificial Sequence
  Description of Artificial Sequence: Synthetic peptide
QHFWSSPWT

SEQ ID NO: 902 - protein, 10 aa, Artificial Sequence
  Description of Artificial Sequence: Synthetic peptide
GYTFTNYWMH

SEQ ID NO: 903 - protein, 17 aa, Artificial Sequence
  Description of Artificial Sequence: Synthetic peptide
FITPTTGYPEYNQKFKD

SEQ ID NO: 904 - protein, 13 aa, Artificial Sequence
  Description of Artificial Sequence: Synthetic peptide
RKVGKGVYYALDY

SEQ ID NO: 905 - protein, 11 aa, Artificial Sequence
  Description of Artificial Sequence: Synthetic peptide
RASGNIHNYLA

SEQ ID NO: 906 - protein, 7 aa, Artificial Sequence
  Description of Artificial Sequence: Synthetic peptide
NTKTLAD

SEQ ID NO: 907 - protein, 9 aa, Artificial Sequence
  Description of Artificial Sequence: Synthetic peptide
QHFWSSPWT

SEQ ID NO: 908 - protein, 10 aa, Artificial Sequence
  Description of Artificial Sequence: Synthetic peptide
GYTFTNYWMH

SEQ ID NO: 909 - protein, 17 aa, Artificial Sequence
  Description of Artificial Sequence: Synthetic peptide
FITPTTGYPEYNQKFKD

SEQ ID NO: 910 - protein, 13 aa, Artificial Sequence
  Description of Artificial Sequence: Synthetic peptide
RKVGKGVYYALDY

SEQ ID NO: 911 - protein, 11 aa, Artificial Sequence
  Description of Artificial Sequence: Synthetic peptide
RASGNIHNYLA

SEQ ID NO: 912 - protein, 7 aa, Artificial Sequence
  Description of Artificial Sequence: Synthetic peptide
NTKTLAD

SEQ ID NO: 913 - protein, 9 aa, Artificial Sequence
  Description of Artificial Sequence: Synthetic peptide
QHFWSSPWT

SEQ ID NO: 914 - protein, 10 aa, Artificial Sequence
  Description of Artificial Sequence: Synthetic peptide
GYTFTNYWMH

SEQ ID NO: 915 - protein, 17 aa, Artificial Sequence
  Description of Artificial Sequence: Synthetic peptide
FITPTTGYPEYNQKFKD

SEQ ID NO: 916 - protein, 13 aa, Artificial Sequence
  Description of Artificial Sequence: Synthetic peptide
RKVGKGVYYALDY

SEQ ID NO: 917 - protein, 11 aa, Artificial Sequence
  Description of Artificial Sequence: Synthetic peptide
RASGNIHNYLA

SEQ ID NO: 918 - protein, 7 aa, Artificial Sequence
  Description of Artificial Sequence: Synthetic peptide
NTKTLAD

SEQ ID NO: 919 - protein, 9 aa, Artificial Sequence
  Description of Artificial Sequence: Synthetic peptide
QHFWSSPWT

SEQ ID NO: 920 - protein, 10 aa, Artificial Sequence
  Description of Artificial Sequence: Synthetic peptide
GYTFTNYNLH

SEQ ID NO: 921 - protein, 17 aa, Artificial Sequence
  Description of Artificial Sequence: Synthetic peptide
AIYPGNYDTSYNQKFKG

SEQ ID NO: 922 - protein, 13 aa, Artificial Sequence
  Description of Artificial Sequence: Synthetic peptide
VDFGHSRYWYFDV

SEQ ID NO: 923 - protein, 10 aa, Artificial Sequence
  Description of Artificial Sequence: Synthetic peptide
RATSSVSSMN

SEQ ID NO: 924 - protein, 7 aa, Artificial Sequence
  Description of Artificial Sequence: Synthetic peptide
ATSNLAS

SEQ ID NO: 925 - protein, 9 aa, Artificial Sequence
  Description of Artificial Sequence: Synthetic peptide
QQWTFNPPT

SEQ ID NO: 926 - protein, 10 aa, Artificial Sequence
  Description of Artificial Sequence: Synthetic peptide
GYTFTNYNLH

SEQ ID NO: 927 - protein, 17 aa, Artificial Sequence
  Description of Artificial Sequence: Synthetic peptide
AIYPGNYDTSYNQKFKG

SEQ ID NO: 928 - protein, 13 aa, Artificial Sequence
  Description of Artificial Sequence: Synthetic peptide
VDFGHSRYWYFDV

SEQ ID NO: 929 - protein, 10 aa, Artificial Sequence
  Description of Artificial Sequence: Synthetic peptide
RATSSVSSMN

SEQ ID NO: 930 - protein, 7 aa, Artificial Sequence
  Description of Artificial Sequence: Synthetic peptide
ATSNLAS

SEQ ID NO: 931 - protein, 9 aa, Artificial Sequence
  Description of Artificial Sequence: Synthetic peptide
QQWTFNPPT

SEQ ID NO: 932 - protein, 10 aa, Artificial Sequence
  Description of Artificial Sequence: Synthetic peptide
RATSSVSSMN

SEQ ID NO: 933 - protein, 7 aa, Artificial Sequence
  Description of Artificial Sequence: Synthetic peptide
ATSNLAS

SEQ ID NO: 934 - protein, 9 aa, Artificial Sequence
  Description of Artificial Sequence: Synthetic peptide
QQWTFNPPT

SEQ ID NO: 935 - protein, 10 aa, Artificial Sequence
  Description of Artificial Sequence: Synthetic peptide
GYTFTNYNLH

SEQ ID NO: 936 - protein, 17 aa, Artificial Sequence
  Description of Artificial Sequence: Synthetic peptide
AIYPGNYDTSYNQKFKG

SEQ ID NO: 937 - protein, 13 aa, Artificial Sequence
  Description of Artificial Sequence: Synthetic peptide
VDFGHSRYWYFDV

SEQ ID NO: 938 - protein, 10 aa, Artificial Sequence
  Description of Artificial Sequence: Synthetic peptide
RATSSVSSMN

SEQ ID NO: 939 - protein, 7 aa, Artificial Sequence
  Description of Artificial Sequence: Synthetic peptide
ATSNLAS

SEQ ID NO: 940 - protein, 9 aa, Artificial Sequence
  Description of Artificial Sequence: Synthetic peptide
QQWTFNPPT

SEQ ID NO: 941 - protein, 10 aa, Artificial Sequence
  Description of Artificial Sequence: Synthetic peptide
GYTFTSYNMH

SEQ ID NO: 942 - protein, 17 aa, Artificial Sequence
  Description of Artificial Sequence: Synthetic peptide
AIYPGNGDTSYNPKFKG

SEQ ID NO: 943 - protein, 13 aa, Artificial Sequence
  Description of Artificial Sequence: Synthetic peptide
SYFYGSSSWYFDV

SEQ ID NO: 944 - protein, 10 aa, Artificial Sequence
  Description of Artificial Sequence: Synthetic peptide
RASSSVSSMH

SEQ ID NO: 945 - protein, 7 aa, Artificial Sequence
  Description of Artificial Sequence: Synthetic peptide
ATSNLAS

SEQ ID NO: 946 - protein, 10 aa, Artificial Sequence
  Description of Artificial Sequence: Synthetic peptide
GYTFTSYNMH

SEQ ID NO: 947 - protein, 17 aa, Artificial Sequence
  Description of Artificial Sequence: Synthetic peptide
AIYPGNGDTSYNPKFKG

SEQ ID NO: 948 - protein, 13 aa, Artificial Sequence
  Description of Artificial Sequence: Synthetic peptide
SYFYGSSSWYFDV

SEQ ID NO: 949 - protein, 10 aa, Artificial Sequence
  Description of Artificial Sequence: Synthetic peptide
RASSSVSSMH

SEQ ID NO: 950 - protein, 7 aa, Artificial Sequence
  Description of Artificial Sequence: Synthetic peptide
ATSNLAS

SEQ ID NO: 951 - protein, 9 aa, Artificial Sequence
  Description of Artificial Sequence: Synthetic peptide
QQWIFNPPT

SEQ ID NO: 952 - protein, 10 aa, Artificial Sequence
  Description of Artificial Sequence: Synthetic peptide
GYTFTSYNMH

SEQ ID NO: 953 - protein, 17 aa, Artificial Sequence
  Description of Artificial Sequence: Synthetic peptide
AIYPGNGDTSYNPKFKG

SEQ ID NO: 954 - protein, 13 aa, Artificial Sequence
  Description of Artificial Sequence: Synthetic peptide
SYFYGSSSWYFDV

SEQ ID NO: 955 - protein, 10 aa, Artificial Sequence
  Description of Artificial Sequence: Synthetic peptide
RASSSVSSMH

SEQ ID NO: 956 - protein, 7 aa, Artificial Sequence
  Description of Artificial Sequence: Synthetic peptide
ATSNLAS

SEQ ID NO: 957 - protein, 9 aa, Artificial Sequence
  Description of Artificial Sequence: Synthetic peptide
QQWIFNPPT

SEQ ID NO: 958 - protein, 10 aa, Artificial Sequence
  Description of Artificial Sequence: Synthetic peptide
GYTFTSYNMH

SEQ ID NO: 959 - protein, 17 aa, Artificial Sequence
  Description of Artificial Sequence: Synthetic peptide
AIYPGNGDTSYNPKFKG

SEQ ID NO: 960 - protein, 13 aa, Artificial Sequence
  Description of Artificial Sequence: Synthetic peptide
SYFYGSSSWYFDV

SEQ ID NO: 961 - protein, 10 aa, Artificial Sequence
  Description of Artificial Sequence: Synthetic peptide
RASSSVSSMH

SEQ ID NO: 962 - protein, 7 aa, Artificial Sequence
  Description of Artificial Sequence: Synthetic peptide
ATSNLAS

SEQ ID NO: 963 - protein, 9 aa, Artificial Sequence
  Description of Artificial Sequence: Synthetic peptide
QQWIFNPPT

SEQ ID NO: 964 - protein, 10 aa, Artificial Sequence
  Description of Artificial Sequence: Synthetic peptide
GYTFTRYNMH

SEQ ID NO: 965 - protein, 17 aa, Artificial Sequence
  Description of Artificial Sequence: Synthetic peptide
AIYPGNGDTSYSQKFKG

SEQ ID NO: 966 - protein, 13 aa, Artificial Sequence
  Description of Artificial Sequence: Synthetic peptide
SFFYGSSDWYFDV

SEQ ID NO: 967 - protein, 10 aa, Artificial Sequence
  Description of Artificial Sequence: Synthetic peptide
RASSSVNNMH

SEQ ID NO: 968 - protein, 7 aa, Artificial Sequence
  Description of Artificial Sequence: Synthetic peptide
ATSNLAS

SEQ ID NO: 969 - protein, 9 aa, Artificial Sequence
  Description of Artificial Sequence: Synthetic peptide
QQWIFNPPT

SEQ ID NO: 970 - protein, 10 aa, Artificial Sequence
  Description of Artificial Sequence: Synthetic peptide
GYTFTRYNMH

SEQ ID NO: 971 - protein, 17 aa, Artificial Sequence
  Description of Artificial Sequence: Synthetic peptide
AIYPGNGDTSYSQKFKG

SEQ ID NO: 972 - protein, 13 aa, Artificial Sequence
  Description of Artificial Sequence: Synthetic peptide
SFFYGSSDWYFDV

SEQ ID NO: 973 - protein, 10 aa, Artificial Sequence
  Description of Artificial Sequence: Synthetic peptide
RASSSVNNMH

SEQ ID NO: 974 - protein, 7 aa, Artificial Sequence
  Description of Artificial Sequence: Synthetic peptide
ATSNLAS

SEQ ID NO: 975 - protein, 9 aa, Artificial Sequence
  Description of Artificial Sequence: Synthetic peptide
QQWIFNPPT

SEQ ID NO: 976 - protein, 10 aa, Artificial Sequence
  Description of Artificial Sequence: Synthetic peptide
GYTFTRYNMH

SEQ ID NO: 977 - protein, 17 aa, Artificial Sequence
  Description of Artificial Sequence: Synthetic peptide
AIYPGNGDTSYSQKFKG

SEQ ID NO: 978 - protein, 13 aa, Artificial Sequence
  Description of Artificial Sequence: Synthetic peptide
SFFYGSSDWYFDV

SEQ ID NO: 979 - protein, 10 aa, Artificial Sequence
  Description of Artificial Sequence: Synthetic peptide
RASSSVNNMH

SEQ ID NO: 980 - protein, 7 aa, Artificial Sequence
  Description of Artificial Sequence: Synthetic peptide
ATSNLAS

SEQ ID NO: 981 - protein, 9 aa, Artificial Sequence
  Description of Artificial Sequence: Synthetic peptide
QQWIFNPPT

SEQ ID NO: 982 - protein, 10 aa, Artificial Sequence
  Description of Artificial Sequence: Synthetic peptide
GYTFTRYNMH

SEQ ID NO: 983 - protein, 17 aa, Artificial Sequence
  Description of Artificial Sequence: Synthetic peptide
AIYPGNGDTSYSQKFKG

SEQ ID NO: 984 - protein, 13 aa, Artificial Sequence
  Description of Artificial Sequence: Synthetic peptide
SFFYGSSDWYFDV

SEQ ID NO: 985 - protein, 10 aa, Artificial Sequence
  Description of Artificial Sequence: Synthetic peptide
RASSSVNNMH

SEQ ID NO: 986 - protein, 7 aa, Artificial Sequence
  Description of Artificial Sequence: Synthetic peptide
ATSNLAS

SEQ ID NO: 987 - protein, 9 aa, Artificial Sequence
  Description of Artificial Sequence: Synthetic peptide
QQWIFNPPT

SEQ ID NO: 988 - protein, 9 aa, Artificial Sequence
  Description of Artificial Sequence: Synthetic peptide
QQWIFNPPT

SEQ ID NO: 989 - protein, 18 aa, Artificial Sequence
  Description of Artificial Sequence: Synthetic peptide
RTYHRSTWYNDYVGSVKS

SEQ ID NO: 990 - protein, 12 aa, Artificial Sequence
  Description of Artificial Sequence: Synthetic peptide
ETDYGDYGAFDI

SEQ ID NO: 991 - protein, 14 aa, Artificial Sequence
  Description of Artificial Sequence: Synthetic peptide
TGSRNDIGAYESVS

SEQ ID NO: 992 - protein, 7 aa, Artificial Sequence
  Description of Artificial Sequence: Synthetic peptide
GVNNRPS

SEQ ID NO: 993 - protein, 11 aa, Artificial Sequence
  Description of Artificial Sequence: Synthetic peptide
SSHTTTSTLYV

SEQ ID NO: 994 - protein, 12 aa, Artificial Sequence
  Description of Artificial Sequence: Synthetic peptide
GDSVSSNSAAWN

SEQ ID NO: 995 - protein, 18 aa, Artificial Sequence
  Description of Artificial Sequence: Synthetic peptide
RTFYRSKWYNDYAVSVKG

SEQ ID NO: 996 - protein, 9 aa, Artificial Sequence
  Description of Artificial Sequence: Synthetic peptide
GDYYYGLDV

SEQ ID NO: 997 - protein, 14 aa, Artificial Sequence
  Description of Artificial Sequence: Synthetic peptide
TGSSSDVGGYNSVS

SEQ ID NO: 998 - protein, 7 aa, Artificial Sequence
  Description of Artificial Sequence: Synthetic peptide
EVINRPS

SEQ ID NO: 999 - protein, 10 aa, Artificial Sequence
  Description of Artificial Sequence: Synthetic peptide
SSYTSSSTYV

SEQ ID NO: 1000 - protein, 12 aa, Artificial Sequence
  Description of Artificial Sequence: Synthetic peptide
GDSVLSNSDTWN

SEQ ID NO: 1001 - protein, 18 aa, Artificial Sequence
  Description of Artificial Sequence: Synthetic peptide
RTYHRSTWYDDYASSVRG

SEQ ID NO: 1002 - protein, 15 aa, Artificial Sequence
  Description of Artificial Sequence: Synthetic peptide
DRLQDGNSWSDAFDV

SEQ ID NO: 1003 - protein, 14 aa, Artificial Sequence
  Description of Artificial Sequence: Synthetic peptide
TGSSSDIGGFNYVS

SEQ ID NO: 1004 - protein, 7 aa, Artificial Sequence
  Description of Artificial Sequence: Synthetic peptide
EVTNRPS

SEQ ID NO: 1005 - protein, 11 aa, Artificial Sequence
  Description of Artificial Sequence: Synthetic peptide
SSYASGSPLYV

SEQ ID NO: 1006 - protein, 12 aa, Artificial Sequence
  Description of Artificial Sequence: Synthetic peptide
GDSVLSNSDTWN

SEQ ID NO: 1007 - protein, 18 aa, Artificial Sequence
  Description of Artificial Sequence: Synthetic peptide
RTYHRSTWYDDYASSVRG

SEQ ID NO: 1008 - protein, 15 aa, Artificial Sequence
  Description of Artificial Sequence: Synthetic peptide
DRLQDGNSWSDAFDV

SEQ ID NO: 1009 - protein, 14 aa, Artificial Sequence
  Description of Artificial Sequence: Synthetic peptide
TGTSSDIGGYNYVS

SEQ ID NO: 1010 - protein, 7 aa, Artificial Sequence
  Description of Artificial Sequence: Synthetic peptide
EVSNRPS

SEQ ID NO: 1011 - protein, 11 aa, Artificial Sequence
  Description of Artificial Sequence: Synthetic peptide
SSYTSSSTLYV

SEQ ID NO: 1012 - protein, 12 aa, Artificial Sequence
  Description of Artificial Sequence: Synthetic peptide
GDSVLSNSDTWN

SEQ ID NO: 1013 - protein, 18 aa, Artificial Sequence
  Description of Artificial Sequence: Synthetic peptide
RTYHRSTWYDDYASSVRG

SEQ ID NO: 1014 - protein, 15 aa, Artificial Sequence
  Description of Artificial Sequence: Synthetic peptide
DRLQDGNSWSDAFDV

SEQ ID NO: 1015 - protein, 14 aa, Artificial Sequence
  Description of Artificial Sequence: Synthetic peptide
TGTSSDVGGYNYVS

SEQ ID NO: 1016 - protein, 7 aa, Artificial Sequence
  Description of Artificial Sequence: Synthetic peptide
EVSNRPS

SEQ ID NO: 1017 - protein, 11 aa, Artificial Sequence
  Description of Artificial Sequence: Synthetic peptide
SSYTSSSTLYV

SEQ ID NO: 1018 - protein, 12 aa, Artificial Sequence
  Description of Artificial Sequence: Synthetic peptide
GDSVLSNSDTWN

SEQ ID NO: 1019 - protein, 18 aa, Artificial Sequence
  Description of Artificial Sequence: Synthetic peptide
RTYHRSTWYDDYASSVRG

SEQ ID NO: 1020 - protein, 15 aa, Artificial Sequence
  Description of Artificial Sequence: Synthetic peptide
DRLQDGNSWSDAFDV

SEQ ID NO: 1021 - protein, 14 aa, Artificial Sequence
  Description of Artificial Sequence: Synthetic peptide
TGTSSDVGGYNYVS

SEQ ID NO: 1022 - protein, 7 aa, Artificial Sequence
  Description of Artificial Sequence: Synthetic peptide
DVSNRPS

SEQ ID NO: 1023 - protein, 11 aa, Artificial Sequence
  Description of Artificial Sequence: Synthetic peptide
SSYTSSSTLYV

SEQ ID NO: 1024 - protein, 12 aa, Artificial Sequence
  Description of Artificial Sequence: Synthetic peptide
GDSVLSNSDTWN

SEQ ID NO: 1025 - protein, 18 aa, Artificial Sequence
  Description of Artificial Sequence: Synthetic peptide
RTYHRSTWYDDYASSVRG

SEQ ID NO: 1026 - protein, 15 aa, Artificial Sequence
  Description of Artificial Sequence: Synthetic peptide
DRLQDGNSWSDAFDV

SEQ ID NO: 1027 - protein, 14 aa, Artificial Sequence
  Description of Artificial Sequence: Synthetic peptide
TGTSSDVGGYNYVS

SEQ ID NO: 1028 - protein, 7 aa, Artificial Sequence
  Description of Artificial Sequence: Synthetic peptide
EVSNRPS

SEQ ID NO: 1029 - protein, 11 aa, Artificial Sequence
  Description of Artificial Sequence: Synthetic peptide
SSYTSSSTLYI

SEQ ID NO: 1030 - protein, 12 aa, Artificial Sequence
  Description of Artificial Sequence: Synthetic peptide
GDSVLSNSDTWN

SEQ ID NO: 1031 - protein, 18 aa, Artificial Sequence
  Description of Artificial Sequence: Synthetic peptide
RTYHRSTWYDDYASSVRG

SEQ ID NO: 1032 - protein, 15 aa, Artificial Sequence
  Description of Artificial Sequence: Synthetic peptide
VRLQDGNSWSDAFDV

SEQ ID NO: 1033 - protein, 14 aa, Artificial Sequence
  Description of Artificial Sequence: Synthetic peptide
TGTSSDVGGYNYVS

SEQ ID NO: 1034 - protein, 7 aa, Artificial Sequence
  Description of Artificial Sequence: Synthetic peptide
DVSNRPS

SEQ ID NO: 1035 - protein, 11 aa, Artificial Sequence
  Description of Artificial Sequence: Synthetic peptide
SSYTSSSTLYV

SEQ ID NO: 1036 - protein, 12 aa, Artificial Sequence
  Description of Artificial Sequence: Synthetic peptide
GDSMLSNSDTWN

SEQ ID NO: 1037 - protein, 18 aa, Artificial Sequence
  Description of Artificial Sequence: Synthetic peptide
RTYHRSTWYDDYASSVRG

SEQ ID NO: 1038 - protein, 15 aa, Artificial Sequence
  Description of Artificial Sequence: Synthetic peptide
VRLQDGNSWSDAFDV

SEQ ID NO: 1039 - protein, 14 aa, Artificial Sequence
  Description of Artificial Sequence: Synthetic peptide
TGTSSDVGGYNYVS

SEQ ID NO: 1040 - protein, 7 aa, Artificial Sequence
  Description of Artificial Sequence: Synthetic peptide
DVSNRPS

SEQ ID NO: 1041 - protein, 11 aa, Artificial Sequence
  Description of Artificial Sequence: Synthetic peptide
SSYTSSSTLYV

SEQ ID NO: 1042 - DNA, 1458 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1043 - protein, 119 aa, Artificial Sequence
  Description of Artificial Sequence: Synthetic polypeptide
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 1044 - protein, 111 aa, Artificial Sequence
  Description of Artificial Sequence: Synthetic polypeptide
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 1045 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 1046 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1047 - protein, 242 aa, Artificial Sequence; identical to SEQ ID NO: 880
  Description of Artificial Sequence: Synthetic polypeptide

SEQ ID NO: 1048 - DNA, 813 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 1049 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1050 - DNA, 1458 bp, Artificial Sequence
  Description of Artificial Sequence: Synthetic polynucleotide
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1051 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 1052 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 1053 - protein, 486 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1054 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 1055 - protein, 486 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1056 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 1057 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1058 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 1059 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1060 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 1061 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1062 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 1063 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1064 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 1065 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1066 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 1067 - protein, 491 aa, Artificial Sequence; identical to SEQ ID NO: 1065
  Description of Artificial Sequence: Synthetic polypeptide

SEQ ID NO: 1068 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 1069 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1070 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 1071 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1072 - DNA, 72 bp, Artificial Sequence
  Description of Artificial Sequence: Synthetic oligonucleotide
atctacatctgggcgcccttggccgggacttgtggggtccttctcctgtcactggttatcaccctttactgc

SEQ ID NO: 1073 - DNA, 126 bp, Artificial Sequence
  Description of Artificial Sequence: Synthetic polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 1074 - DNA, 336 bp, Artificial Sequence
  Description of Artificial Sequence: Synthetic polynucleotide
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1075 - protein, 17 aa, Artificial Sequence
  Description of Artificial Sequence: Synthetic peptide
  MOD_RES (7)..(7): Tyr or Gly
  MOD_RES (13)..(13): Gln or Pro
AIYPGNXDTSYNXKFKG

SEQ ID NO: 1076 - protein, 13 aa, Artificial Sequence
  Description of Artificial Sequence: Synthetic peptide
  MOD_RES (1)..(1): Val or Ser
  MOD_RES (2)..(2): Asp or Tyr
  MOD_RES (4)..(4): Gly or Tyr
  MOD_RES (5)..(5): His or Gly
  MOD_RES (7)..(7): Arg or Ser
  MOD_RES (8)..(8): Tyr or Ser
XXFXXSXXWYFDV

SEQ ID NO: 1077 - protein, 10 aa, Artificial Sequence
  Description of Artificial Sequence: Synthetic peptide
  MOD_RES (3)..(3): Thr or Ser
  MOD_RES (10)..(10): Asn or His
RAXSSVSSMX

SEQ ID NO: 1078 - protein, 7 aa, Artificial Sequence
  Description of Artificial Sequence: Synthetic peptide
ATSNLAS

SEQ ID NO: 1079 - protein, 9 aa, Artificial Sequence
  Description of Artificial Sequence: Synthetic peptide
  MOD_RES (4)..(4): Thr or Ile
QQWXFNPPT

SEQ ID NO: 1080 - protein, 21 aa, Artificial Sequence
  Description of Artificial Sequence: Synthetic peptide
MALPVTALLLPLALLLHAARP

SEQ ID NO: 1081 - DNA, 63 bp, Artificial Sequence; identical to SEQ ID NO: 798
  Description of Artificial Sequence: Synthetic oligonucleotide

SEQ ID NO: 1082 - protein, 30 aa, Artificial Sequence
  Description of Artificial Sequence: Synthetic polypeptide
  MISC_FEATURE (1)..(30): This sequence may encompass 0-6 'Gly Gly Gly Gly Ser' repeating units
GGGGSGGGGSGGGGSGGGGSGGGGSGGGGS

SEQ ID NO: 1083 - protein, 5 aa, Artificial Sequence
  Description of Artificial Sequence: Synthetic peptide
GGGGS

SEQ ID NO: 1084 - protein, 15 aa, Artificial Sequence
  Description of Artificial Sequence: Synthetic peptide
GGGGSGGGGSGGGGS

SEQ ID NO: 1085 - protein, 10 aa, Artificial Sequence
  Description of Artificial Sequence: Synthetic peptide
GGGGSGGGGS

SEQ ID NO: 1086 - protein, 20 aa, Artificial Sequence
  Description of Artificial Sequence: Synthetic peptide
GGGGSGGGGSGGGGSGGGGS

SEQ ID NO: 1087 - protein, 25 aa, Artificial Sequence
  Description of Artificial Sequence: Synthetic peptide
GGGGSGGGGSGGGGSGGGGSGGGGS

SEQ ID NO: 1088 - protein, 30 aa, Artificial Sequence; identical to SEQ ID NO: 1082
  Description of Artificial Sequence: Synthetic polypeptide

SEQ ID NO: 1089 - protein, 30 aa, Artificial Sequence; identical to SEQ ID NO: 1082
  Description of Artificial Sequence: Synthetic polypeptide
  MISC_FEATURE (1)..(30): This sequence may encompass 1-6 'Gly Gly Gly Gly Ser' repeating units

SEQ ID NO: 1090 - protein, 5 aa, Artificial Sequence
  Description of Artificial Sequence: Synthetic peptide
GGGGS

SEQ ID NO: 1091 - protein, 7 aa, Artificial Sequence
  Description of Artificial Sequence: Synthetic peptide
LAEAAAK

SEQ ID NO: 1092 - DNA, 5000 bp, Artificial Sequence
  Description of Artificial Sequence: Synthetic polynucleotide
  misc_feature (1)..(5000): This sequence may encompass 50-5000 nucleotides
  See specification as filed for detailed description of substitutions and preferred embodiments
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1093 - DNA, 2000 bp, Artificial Sequence
  Description of Artificial Sequence: Synthetic polynucleotide
  misc_feature (1)..(2000): This sequence may encompass 50-2000 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1094 - DNA, 100 bp, Artificial Sequence
  Description of Artificial Sequence: Synthetic polynucleotide
tttttttttttttttttttttttttttttttttttttttttttttttttttttttttttttttttttttttttttttttttttttttttttttttttttt

SEQ ID NO: 1095 - DNA, 5000 bp, Artificial Sequence
  Description of Artificial Sequence: Synthetic polynucleotide
  misc_feature (1)..(5000): This sequence may encompass 50-5000 nucleotides
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 1096 - DNA, 5000 bp, Artificial Sequence; identical to SEQ ID NO: 1092
  Description of Artificial Sequence: Synthetic polynucleotide
  misc_feature (1)..(5000): This sequence may encompass 100-5000 nucleotides

SEQ ID NO: 1097 - protein, 465 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1098 - protein, 465 aa, Artificial Sequence; identical to SEQ ID NO: 1097
  Description of Artificial Sequence: Synthetic polypeptide

SEQ ID NO: 1099 - protein, 10 aa, Artificial Sequence
  Description of Artificial Sequence: Synthetic peptide
GVSLPDYGVS

SEQ ID NO: 1100 - protein, 12 aa, Artificial Sequence
  Description of Artificial Sequence: Synthetic peptide
GDSVSNNNAAWN

SEQ ID NO: 1101 - protein, 243 aa, Artificial Sequence; identical to SEQ ID NO: 837
  Description of Artificial Sequence: Synthetic polypeptide

SEQ ID NO: 1102 - protein, 243 aa, Artificial Sequence; identical to SEQ ID NO: 835
  Description of Artificial Sequence: Synthetic polypeptide

SEQ ID NO: 1103 - protein, 4 aa, Artificial Sequence
  Description of Artificial Sequence: Synthetic peptide
RGDS

We claim:

1. An isolated nucleic acid molecule encoding a chimeric antigen receptor (CAR), wherein the CAR comprises a CD20 binding domain, a transmembrane domain, and an intracellular signaling domain, wherein said CD20 binding domain comprises a light chain complementarity determining region 1 (LCDR1), light chain complementarity determining region 2 (LCDR2), light chain complementarity determining region 3 (LCDR3) heavy chain complementarity determining region 1 (HCDR1), heavy chain complementarity determining region 2 (HCDR2), and heavy chain complementarity determining region 3 (HCDR3), wherein the LCDR1, LCDR2, LCDR3, HCDR1, HCDR2, and HCDR3 comprise:
   (i) SEQ ID NOs: 147, 148, 149, 136, 137, and 138, respectively;
   (ii) SEQ ID NOs: 150, 151, 152, 139, 140, and 141, respectively;
   (iii) SEQ ID NOs: 153, 154, 155, 142, 143, and 144, respectively; or
   (iv) SEQ ID NOs: 929, 930, 931, 926, 927, and 928, respectively.

2. The isolated nucleic acid molecule of claim 1, wherein the CD20 binding domain comprises a light chain variable region (VL) and a heavy chain variable region (VH), wherein:
   (i) the VL comprises the amino acid sequence of SEQ ID NO: 156, 129, or 439, or an amino acid sequence with at least 95% identity thereto;
   (ii) the VH comprises the amino acid sequence of SEQ ID NO: 145, 118, or 437, or an amino acid sequence with at least 95% identity thereto; or
   (iii) the VL and VH comprise:
      (a) SEQ ID NOs: 156 and 145, respectively;
      (b) SEQ ID NOs: 129 and 118, respectively; or
      (c) SEQ ID NOs: 439 and 437, respectively.

3. The isolated nucleic acid molecule of claim 1, wherein:
   (i) the nucleic acid molecule comprises the nucleotide sequence of SEQ ID NO: 157, 130, or 440, or a nucleotide sequence with at least 95% identity thereto;
   (ii) the nucleic acid molecule comprises the nucleotide sequence of SEQ ID NO: 146, 119, or 438, or a nucleotide sequence with at least 95% identity thereto; or
   (iii) the nucleic acid molecule comprises:
      (a) SEQ ID NOs: 157 and 146;
      (b) SEQ ID NOs: 130 and 119; or
      (c) SEQ ID NOs: 440 and 438.

4. The isolated nucleic acid molecule of claim 1, wherein the CD20 binding domain comprises the amino acid sequence of SEQ ID NO: 159 or 132, or an amino acid sequence with at least 95% identity thereto.

5. The isolated nucleic acid molecule of claim 1, wherein the nucleic acid molecule comprises the nucleotide sequence of SEQ ID NO: 160 or 133, or a nucleotide sequence with at least 95% identity thereto.

6. The isolated nucleic acid molecule of claim 1, wherein the transmembrane domain comprises a transmembrane domain of a protein selected from the group consisting of the alpha, beta or zeta chain of T-cell receptor, CD28, CD3 epsilon, CD45, CD4, CD5, CD8, CD9, CD16, CD22, CD33, CD37, CD64, CD80, CD86, CD123, CD134, CD137 and CD154.

7. The isolated nucleic acid molecule of claim 1, wherein:
   (i) the transmembrane domain comprises the amino acid sequence of SEQ ID NO: 801, or an amino acid sequence with at least 95% identity thereto; or
   (ii) the nucleic acid molecule comprises the nucleotide sequence of SEQ ID NO: 802 or 1072, or a nucleotide sequence with at least 95% identity thereto.

8. The isolated nucleic acid molecule of claim 1, wherein the CD20 binding domain is connected to the transmembrane domain by a hinge region.

9. The isolated nucleic acid molecule of claim 8, wherein:
   (i) the hinge region comprises the amino acid sequence of SEQ ID NO: 799 or SEQ ID NO: 814, or an amino acid sequence with at least 95% identity thereto; or
   (ii) the nucleic acid molecule comprises the nucleotide sequence of SEQ ID NO: 800 or SEQ ID NO: 815, or a nucleotide sequence with at least 95% identity thereto.

10. The isolated nucleic acid molecule of claim 1, wherein the intracellular signaling domain comprises a costimulatory domain, wherein the costimulatory domain is a functional signaling domain obtained from a protein selected from the group consisting of OX40, CD2, CD27, CD28, CDS, ICAM-1, LFA-1 (CD11a/CD18), ICOS (CD278) and 4-1BB (CD137).

11. The isolated nucleic acid molecule of claim 1, wherein the intracellular signaling domain comprises a costimulatory domain, wherein:
   (i) the costimulatory domain comprises the amino acid sequence of SEQ ID NO: 803, or an amino acid sequence with at least 95% identity thereto; or
   (ii) the nucleic acid molecule comprises the nucleotide sequence of SEQ ID NO: 804, or a nucleotide sequence with at least 95% identity thereto.

12. The isolated nucleic acid molecule of claim 1, wherein the intracellular signaling domain comprises a primary signaling domain, wherein the primary signaling domain comprises a functional signaling domain of CD3 zeta.

13. The isolated nucleic acid molecule of claim 1, wherein the intracellular signaling domain comprises a primary signaling domain, wherein:

(i) the primary signaling domain comprises the amino acid sequence of SEQ ID NO: 807 or SEQ ID NO: 805, or an amino acid sequence with at least 95% identity thereto; or (ii) the nucleic acid molecule comprises the nucleotide sequence of SEQ ID NO: 893, 808, 806, or 1074, or a nucleotide sequence with at least 95% identity thereto.

14. The isolated nucleic acid molecule of claim 1, wherein the intracellular signaling domain comprises a functional signaling domain of 4-1BB and/or a functional signaling domain of CD3 zeta.

15. The isolated nucleic acid molecule of claim 1, wherein:
(i) the intracellular signaling domain comprises the amino acid sequence of SEQ ID NO: 803, or an amino acid sequence with at least 95% identity thereto, and the amino acid sequence of SEQ ID NO: 807 or SEQ ID NO: 805, or an amino acid sequence with at least 95% identity thereto;
(ii) the intracellular signaling domain comprises the amino acid sequence of SEQ ID NO: 803 and the amino acid sequence of SEQ ID NO: 807 or SEQ ID NO: 805;
(iii) the intracellular signaling domain comprises the amino acid sequence of SEQ ID NO: 803 and the amino acid sequence of SEQ ID NO: 807 or SEQ ID NO: 805, wherein the sequences comprising the intracellular signaling domain are expressed in the same frame and as a single polypeptide chain, or
(iv) the nucleic acid molecule comprises the nucleotide sequence of SEQ ID NO: 804, or a nucleotide sequence with at least 95% identity thereto, and/or the nucleotide sequence of SEQ ID NO: 893, 808, 806, or 1074, or a nucleotide sequence with at least 95% identity thereto.

16. The isolated nucleic acid molecule of claim 1, further comprising a leader sequence, wherein the leader sequence encodes a polypeptide comprising the amino acid sequence of SEQ ID NO: 797, or an amino acid sequence with at least 95% identity thereto.

17. The isolated nucleic acid molecule of claim 1, wherein the nucleic acid molecule encodes a CAR comprising the amino acid sequence of SEQ ID NO: 161 or 134, or an amino acid sequence with at least 95% identity thereto, wherein the CAR comprises or does not comprise a signal peptide comprising the amino acid sequence of SEQ ID NO: 797.

18. The isolated nucleic acid molecule of claim 1, wherein the nucleic acid molecule comprises the nucleotide sequence of SEQ ID NO: 162 or 135, or a nucleotide sequence with at least 95% identity thereto, wherein the nucleic acid molecule comprises or does not comprise the nucleotide sequence of SEQ ID NO: 798.

19. A nucleic acid comprising:
(i) a first nucleic acid comprising the nucleic acid molecule of claim 1, and
(ii) a second nucleic acid encoding a CAR molecule that binds a B-cell antigen.

20. The nucleic acid of claim 19, wherein the B cell antigen is CD19, CD22, CD10, CD34, CD123, FLT-3, ROR-1, CD79b, CD79a, or CD179b.

21. The nucleic acid of claim 19, wherein:
(i) the first and the second nucleic acids are disposed on a single nucleic acid molecule, or
(ii) the first and the second nucleic acids are disposed on separate nucleic acid molecules.

22. The nucleic acid of claim 19, wherein the B-cell antigen is CD19 or CD22.

23. The nucleic acid of claim 19, wherein the CAR molecule that binds a B-cell antigen binds CD19 and comprises:
(i) a HCDR1, HCDR2, HCDR3, LCDR1, LCDR2, and LCDR3 comprising SEQ ID NOs: 773, 774, 775, 776, 777, and 778, respectively;
(ii) a scFv comprising the amino acid sequence of SEQ ID NO: 765; or
(iii) a CAR comprising the amino acid sequence of SEQ ID NO: 764, wherein the CAR molecule comprises or does not comprise a signal peptide comprising the amino acid sequence of SEQ ID NO: 797.

24. The nucleic acid of claim 19, wherein the CAR molecule that binds a B-cell antigen binds CD19 and comprises:
(i) a HCDR1, HCDR2, HCDR3, LCDR1, LCDR2, and LCDR3 comprising SEQ ID NOs: 785, 786, 787, 788, 789, and 790, respectively;
(ii) a scFv comprising the amino acid sequence of SEQ ID NO: 1047; or
(iii) a CAR comprising the amino acid sequence of SEQ ID NO: 1049, wherein the CAR molecule comprises or does not comprise a signal peptide comprising the amino acid sequence of SEQ ID NO: 797.

25. The nucleic acid of claim 19, wherein a nucleotide sequence encoding a cleavable peptide, or a nucleotide sequence encoding an IRES is disposed between the first nucleic acid and the second nucleic acid.

26. The nucleic acid of claim 19, wherein:
(i) the first nucleic acid and the second nucleic acid comprise a single promoter, wherein the single promoter is an EF-1α promoter; or
(ii) the first nucleic acid comprises a first promoter and the second nucleic acid comprises a second promoter.

27. A vector comprising the nucleic acid molecule of claim 1.

28. A method of making a cell, comprising transducing a T cell or an NK cell with the nucleic acid molecule of claim 1.

29. A method of generating a population of RNA-engineered cells comprising introducing an in vitro transcribed RNA or synthetic RNA into a cell, wherein the RNA comprises the nucleic acid molecule of claim 1.

30. An isolated cell comprising the nucleic acid molecule of claim 1.

31. The isolated cell of claim 30, further expressing:
(i) an inhibitory molecule that comprises a first polypeptide that comprises at least a portion of an inhibitory molecule, associated with a second polypeptide that comprises a costimulatory domain and primary signaling domain, or
(ii) an inhibitory molecule that comprises a first polypeptide that comprises at least a portion of Programmed Death 1 (PD1) and a second polypeptide comprising a costimulatory domain and primary signaling domain.

32. A population of immune effector cells, comprising:
(i) a first cell population comprising the nucleic acid molecule of claim 1; and
(ii) a second cell population comprising a nucleic acid encoding a CAR that binds a B-cell antigen.

33. The population of claim 32, wherein:
(i) the B-cell antigen is chosen from CD19, CD22, CD10, CD34, CD123, FLT-3, ROR-1, CD79b, CD79a, or CD179b, or
(ii) the B-cell antigen is CD19 or CD22.

* * * * *